United States Patent 11,098,302 (IDENTIFICATION OF POLYNUCLEOTIDES ASSOCIATED WITH A SAMPLE) - sequence listing, part 109

SEQ ID NO: 375176 - DNA, 557 bp, Homo sapiens
  misc_feature: GZ8MTXP02JQ05S.13.28.C06.1.454.CMB.2.raw
  modified_base (283)..(283): a, c, t, g, unknown or other
  modified_base (385)..(385): a, c, t, g, unknown or other
  modified_base (402)..(402): a, c, t, g, unknown or other
  modified_base (551)..(551): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtggggggtccctgagactctcctgtgtagcctctggtatttgttttagngactattggatgtagttgggtccgcgaggctccgagggaaggggctggagtggggtggccaacataaagtacgatagaagttgagataaattatttggactntgtgagggccattcacntctcgagggacaacgaccaagaactcgctagtactctgacaaagtggagagcctgagagccggagacacgggctgtatagttactgtgtgagattagcgtacacttactttgaccgtaacgtcggggaccaggggaacccctggtaccncgttcc

SEQ ID NO: 375177 - DNA, 562 bp, Homo sapiens
  misc_feature: GZ8MTXP02GHAF6.13.28.C06.1.454.CMB.2.raw
  modified_base (377)..(377): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctgggggtccctgagactctcctgtgtagcctctggatttgttttagtgactattggatgagttgggtccgccaggctccgagggaggggctggagtggggtggccaacataaagtacgatgaagttgagataaattattgactntgtgagggcattcaccatctgagggacaacgcaaagaactcgcttgatctgcaaaagtggaaagtagcctagagaggacccggaaggaccacgggctgtaatattagttgtgttgagtacttagcgctacttactttgacttaacgcgggggtaccacggggtaaccctgggtaccacccgttcc

SEQ ID NO: 375178 - DNA, 588 bp, Homo sapiens
  misc_feature: GZ8MTXP02II4FK.13.28.C06.1.454.CMB.2.raw
  modified_base (379)..(379): a, c, t, g, unknown or other
  modified_base (399)..(399): a, c, t, g, unknown or other
  modified_base (402)..(402): a, c, t, g, unknown or other
  modified_base (443)..(443): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtggggggtccctgagactctcctgtgtagcctctggatttgttttagtgactattggatgagttggtccgccaggctccgagggaggggctggaggtgggtggccaaacataaagtacgatgaagttgaagataaattattgatntgtgagggcattcaccatcncgngggacaacgccaaagactcgctgtatctgacaaagtggganagcctggaagacgccggaagggaccacggggcttaggtattaagtttagttgtaggttggaagtagttacgcgactaccgttacttttgacttaacggtcgggggacccaacgggggaacccccttgggtacccgacccggttcc

SEQ ID NO: 375179 - DNA, 628 bp, Homo sapiens
  misc_feature: GZ8MTXP02F5VW3.13.28.C06.1.454.CMB.2.raw
  modified_base (283)..(283): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtgggggtccctgagactctcctgtgtagcctctggtatttgtttttagngactattggatggaggttgggtccgccgaggcctccgaggggaaggggctggaggtgggtggccaaacgataaaggtacgatgaagttgagtaataaattgttaggacttctggttagaggggccaattcaccatctcggagggacaacgccaaagaactcgcttagactctagacaaaagtgggaagagccgtggagacggacccggaaggaccgacgggtctaggttaattattagttggtagtaggtaagtatttacggcgtactaacgttactttcgaacttaaccggtagggggaccctaaacgggggtaacccccgttgggtaccccaacggtttcccc

SEQ ID NO: 375180 - DNA, 605 bp, Homo sapiens
  misc_feature: GZ8MTXP02FU2JU.13.28.C06.1.454.CMB.2.raw
  modified_base (384)..(384): a, c, t, g, unknown or other
  modified_base (404)..(404): a, c, t, g, unknown or other
  modified_base (532)..(532): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtgggggtccctgagactctcctgtgtagcctctggatttgttttagtgactattggatggagttggggtccgcgaggctccgaggggaaggggctggagtggggtggccaaacataaagtacgatagaagttgagataaattattgactntgtgagggcattcaccatcncgaggacaacgccaaagaactcgctgtatctagacaaaagtgggaagacgaccgtggaacgagacccgggtaggaaaccgcggggtctaggtaattaagttagtttgtgttaggagtaagttacggcnctaacttacgtttcggaacttaaccggtgggggaccctaaacgggggaacccctgggtccctaacccggtccc

SEQ ID NO: 375181 - DNA, 637 bp, Homo sapiens
  misc_feature: GZ8MTXP02HUOLP.13.28.C06.1.454.CMB.2.raw
  modified_base (280)..(280): a, c, t, g, unknown or other
  modified_base (346)..(346): a, c, t, g, unknown or other
  modified_base (497)..(497): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgagtgcacctggtggagtccgggggagacttggtccagccgtgggggtccctgagctctcctgtgtagcctctggtatttgttttagngactattggatgagttgggtccgcgaggctaccggaggggaaggggctggaggtgggtggccaaanataaaggtcgatgaaagttgaagtaattaaaatttagttttaggacttcgttaggtaggacgggggtccgtaattccaaccctattccgtacggacggggaaaccaaacgacccaaagaacctcgacttgtactctgacaaagtggagacncgtaggagacggccggaaggtaccacgggcttaggtaattaagttgttgtgtgaaagttacgttacgcgtactaccgttactttcgaacgttaacggtcggggacccgacgggaaccccgttggaccctacccggttccc

SEQ ID NO: 375182 - DNA, 606 bp, Homo sapiens
  misc_feature: GZ8MTXP02GPIPO.13.28.C06.1.454.CMB.2.raw
  modified_base (337)..(337): a, c, t, g, unknown or other
  modified_base (342)..(342): a, c, t, g, unknown or other
  modified_base (402)..(402): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccagccgtggggggtccctgagactctcctgtgtagcctctggtatttgttttagtgactagttggatgagttgggtccgcgaggctccgagggaggggctggagtggngcaanataaagtacgatagaagtgagtaataaattattggactgtgtggagggccattcacatcncgagggacaacgaccaaagaactcgctgtatctgacaaaagtggagagccgtggagacggccgaaggaccgacgggtcttagtattagtgtagaacaaaagtactaccctaaacccctttaagtacgtttttacggaacgtttggttaacgtaaccggtagggttacgggggacccgtaacggggtacccgtagggtcctaacg

SEQ ID NO: 375183 - DNA, 592 bp, Homo sapiens
  misc_feature: GZ8MTXP02G3LMJ.13.28.C06.1.454.CMB.2.raw
  modified_base (268)..(268): a, c, t, g, unknown or other
  modified_base (284)..(284): a, c, t, g, unknown or other
  modified_base (313)..(313): a, c, t, g, unknown or other
  modified_base (443)..(443): a, c, t, g, unknown or other
  modified_base (475)..(475): a, c, t, g, unknown or other
  modified_base (480)..(480): a, c, t, g, unknown or other
  modified_base (482)..(482): a, c, t, g, unknown or other
  modified_base (485)..(485): a, c, t, g, unknown or other
  modified_base (487)..(487): a, c, t, g, unknown or other
tcagtcacgtactacacgaccggtgctcgattagagctcacgtattgggtttggggagggtctcagagaggagccttagccctggactccaaggcctttccacttggtgatcagcactgagcacagaggactcaccatggaattggggctgaactgggttttccttgttgctattttagaaggtgtccagtgtgaagtgcactggtggagtccgggggagacttggtccagccgtggggggtccctggagactctcctgtgcaacctntggattctattttccnctgaccgcctaggttcgagcttgggtccnccaggcctccggggaagggctggaggtgggttggccgttaagttaaaggtagaagacagtgggtacggaaccaaacagaactacaggttcgttaccccgtggaaacggtcaaggactttcactatcctanaaagagatgaactaacaaaaagatgaatatanctaananaananaaacaacaagaaagacgagacgacgacggagtagtagtacgtacgtacacacgacgacggacgacgacgacgaacgaacgacggacgacgacgtacgtacgtacg

SEQ ID NO: 375184 - DNA, 689 bp, Homo sapiens
  misc_feature: GZ8MTXP02FFNNR.13.28.C06.1.454.CMB.2.raw
  modified_base (220)..(220): a, c, t, g, unknown or other
  modified_base (287)..(287): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttcctgttgcttattttagaaggtgtccagtgtgagtgcacgtggtggagtccggggganacgttggtccaggccgtggggggtccctggagactctcctgtgtagcctgtggtattttgttttagngtacttagtggatggaggttcgggtccgccgaggctccggaaggggaggggctggggaggttggggtcggaccaaacgaagtaaaacggtacggaagttaggaaagtttggaagtaatttaaaacgttttagtttgggaccttcgttaggtagggaacggggtcccgtaatttccaaccgtatccggtacggaacgggggaaacccaaaaccggaccccgaaaaggaacccttcggacttagtaacttccgtaggaactaaaagtcggggaaagtcgccgtaggaagacgccgggaaggacctagggctagtatattgttgtgagtagtacttacgccgtactacgtttacttgacctaacggtcgggggacccaaggggtacccctggtcccacccgttcc

SEQ ID NO: 375185 - DNA, 553 bp, Homo sapiens
  misc_feature: GZ8MTXP02FTJ9Y.13.28.C06.1.454.CMB.2.raw
  modified_base (477)..(477): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgcccagtgtgaggtgcagctggtggagtctggaggaggcttgatccagccgtgggggtccctgagactctcctgtgcagcctctgggttcaccgtcagtcacacctacatgagctgggtccgccaggcctccgaggggaagggctggagtgcgtctattttattatagtagtgtagtacatactccgcagctccgtgaggggccgtattccacctatcctaccagagaacaattaccaaagaaccacgcttagtttactacaaatgaacagaccctgagacgccgaatcgaacncggcctagtacttactgtagcgagaggcgtcgggggaacccaacggaaacgttactacgacctagtacggtaccgg

SEQ ID NO: 375186 - DNA, 604 bp, Homo sapiens
  misc_feature: GZ8MTXP02G2VSY.13.28.C06.1.454.CMB.2.raw
  modified_base (375)..(375): a, c, t, g, unknown or other
  modified_base (508)..(508): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctatttagaaggtgtccagtgtgaagtgcactggtggagtccggggagacttggccagccgtgggggtcctggagactctcctgtgcagcctcgtggttcaccgtcagtcacacctacatgagcgtcgggtccgccgaggcctccgaggggaggggcgtggagtgcgttcttcttttattatagtagtggtagtacatactcgcanacgtcgtgacggggcctatcacatccacagacgaacaacttaccaaagaaccacgtcttacgtttacttacaaattgaaacagacccgtagagtacggacccgaatcgaaccgtacggccgttagtattacgngtacgaggagacggacggtcgggggacccaaacggtaccgtttaacgaaccgtgtaacggtcggtaaccgtcggtacgggggacccaaaccggggg

SEQ ID NO: 375187 - DNA, 695 bp, Homo sapiens
  misc_feature: GZ8MTXP02FM670.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtgggggtccctgagactctcctgtgtagcctctggtattttgttttagtgtactattggatggagttgggtccgccgaggctccgaggggaggggcgtggaggtggggtggaccaaacgagtaaaagtacgagtaggaagttagaagtaattaaaagtttagtttagggaacttcgtaggttagggacgggggcccgtaatttaccgaaccattccgtacgggaaacgggggtaacccaaaccggaccccaaaagaacctcggacttaggtactctaggaacaaaagtcgggaagtacggcctaggagacggcccgggaaggtaccgacggggtactagggttaattagtttagttggtagttagaggtaacgttacggccgactaacgtttaacgtttcgaaacgttccggtacgggggtacccacgggggtaaccccttcggacccgtacccggttccc

SEQ ID NO: 375188 - DNA, 653 bp, Homo sapiens
  misc_feature: GZ8MTXP02GTDS5.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccagccgtgggggtccctgagactctcctgtgtagcctctggtattttgttttagtgtactagttggatgaggttgggtccgcgaggctccgaggggaggggctgggaggtgggtggccaaacgataaaagtacgatagaagtgaagaataaattatttggactcgtggtggagggccgattcaccatctcgagggacaacgccaaagactcgctgtactctagacaaaagtgggaagtacgcccgtaggaggaacggacccgggaaggaacccgaacggggctaggttaaattatttaagttgggttaggtagtaaggtaaactttacggcgtaccgtaacctttaacgttttcggaaacccttaacggtcggggggaacccaaacggggggtaaccccctggggtaccctaaccccggttccc

SEQ ID NO: 375189 - DNA, 685 bp, Homo sapiens
  misc_feature: GZ8MTXP02FQI96.13.28.C06.1.454.CMB.2.raw
  modified_base (267)..(267): a, c, t, g, unknown or other
  modified_base (283)..(283): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcatcatggaattggggctgaactgggttttccttgttgctatttagaaggtgtccagtgtgaagtgcacctggtggaggtccgggggagacttggtccaggccgtgggggtccctgagactctcctgtgtagcctntggtatttgttttagngtactagttgggatggaggtttcgggtccgccaggcctaccgaggggaaggggctgggaggtggggtggccaaacgagtaaagtacgataggaaagtttgaagtaattaaatttagtttaggactcgtggtgggaagggccgtattccacctattcgtacgggaacggggaaccgaaaccgacccgaaaggaaaccgttcggaccttggttaactccgtaggaaactaaagtcggggaaagacggccgtaggaacggacggaccccgggaaggacccgacggtacgttagttaagttatttaaggttgtaggttagaacgtagttacgccggtactaactttaccgtttagaaccgttacggtcgggggaccccgaaggggtacccctgggtaccctacccg

SEQ ID NO: 375190 - DNA, 567 bp, Homo sapiens
  misc_feature: GZ8MTXP02F544Y.13.28.C06.1.454.CMB.2.raw
  modified_base (267)..(267): a, c, t, g, unknown or other
  modified_base (330)..(330): a, c, t, g, unknown or other
  modified_base (335)..(335): a, c, t, g, unknown or other
  modified_base (367)..(367): a, c, t, g, unknown or other
  modified_base (389)..(389): a, c, t, g, unknown or other
  modified_base (438)..(438): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcaccgtggtggagtccgggggagacttggtccagccgtgggggtccctgagactctcctgtgtagcctntggtatttgttttagtgacttatggatgagttggtccgcaggctcgaggagggctggagtggngcaanataaagcgatgaagtgagataattattgactntgagagggcgattcaccatcgngacgggaacaacgaccaaagactcgctagtatctagacaaaagtggaanacgaccgtaggagacgaccggaaggaaccgacggtctagtaattattatgtgagtagtatacgcgtactacttacgttcgaacgtaacgtcggggacccacgggggaccctcggtaccgtaccgttccc

SEQ ID NO: 375191 - DNA, 668 bp, Homo sapiens
  misc_feature: GZ8MTXP02G87D7.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccaggccgtggggggtccctgagactctcctgtgtagcctcgtggtattttgttttagtgtactattggatgtaggttggtccgcgaggctccgaggggaaggggcgtggaggtggggtcggaccaaacgaagtaaaaggtacgatagaagttgaagtaattaaaatttagtttaggactcgtggtaggaggggccgtattccaccatcgtacggagggaccaacgaccaaagaacctcgactagtactcgtagactaaaagtggaaagtgaccgttaggaagacgggacccgggaaaggaccgacgggacttaggtaattagtttaagttgtaggtacgtaaggtagtttacggaccgtactacgtttacgtttacgaacgttaaccggtgggggtaacccgacggggtaaccccttcgggtaccctaacccggtttcc

SEQ ID NO: 375192 - DNA, 604 bp, Homo sapiens
  misc_feature: GZ8MTXP02GKZPI.13.28.C06.1.454.CMB.2.raw
  modified_base (283)..(283): a, c, t, g, unknown or other
  modified_base (392)..(392): a, c, t, g, unknown or other
  modified_base (512)..(512): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtggggggtccctgagactctcctgtgtagcctctggtatttgttttagngtactattggatgagttgggtccgcaggctccgagggaggggctggagtggggtgaccaacaagtaaaagtacgaatagaagttgaagaattaaaattatttggacttntgtagaggggccattcaccatcgacgagggacaacgcaaagaactcgctgtatctgactaaaagtggaagacgcctaggagacggccggaaggaccaacggctagtaacttattattagngtagagagttacgcgactaaccttacttttcggaacttaacggttcgggggaccgaacgggggtaaccccctggtcccgtacccggttcccg

SEQ ID NO: 375193 - DNA, 587 bp, Homo sapiens
  misc_feature: GZ8MTXP02FXU8X.13.28.C06.1.454.CMB.2.raw
  modified_base (340)..(340): a, c, t, g, unknown or other
  modified_base (377)..(377): a, c, t, g, unknown or other
  modified_base (475)..(475): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtgggggtccctgagactctcctgtgtagcctctggatttgttttagtgactatggatgagttgggtccgccaggctccgagggaggggctggagtgggtggccaanataaagtacgatgaagttgagataaattattggactntgtgagggccgattcaccatctcgagggacacgccaaagaactcgctgatctgacaaaagtgggaacgagcctggagagcccggaaggaccacgggtntagtaattagttagttgtgtagtagtattacggcgtactaacgttacgtttagaaccgttaacggtcgggggaacccgtaacggggtaaccccttgggtaccctacccgtcc

SEQ ID NO: 375194 - DNA, 564 bp, Homo sapiens
  misc_feature: GZ8MTXP02HW7F7.13.28.C06.1.454.CMB.2.raw
  modified_base (339)..(339): a, c, t, g, unknown or other
  modified_base (378)..(378): a, c, t, g, unknown or other
  modified_base (446)..(446): a, c, t, g, unknown or other
  modified_base (477)..(477): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaatggggctgaactgggtttccttgtgctatttagaaggtgtccagtgtgaagtgcacctggtggagtccgggggagacttggtccagccgtggggggtccctgagactctcctgtgtagcctctggtatttgttttagtgactattggatgagttggtccgcaggctccgaggggaaggggctggagtgggtgaccaanataaagtacgatgaagtgaagtataaattagttgacttntgtagacgggcgtatcgaccatcgtgacggacaacgcaaagactgctgtatctagacaaagtgggaanagcctaggagacggcggaacggacacgggtntagtattattagttgtagtagatatcgctactacttacgttgaacgtcggtcggggaccgtacgggtaccctcggtacctaccgtcc

SEQ ID NO: 375195 - DNA, 565 bp, Homo sapiens
  misc_feature: GZ8MTXP02H325S.13.28.C06.1.454.CMB.2.raw
  modified_base (265)..(265): a, c, t, g, unknown or other
  modified_base (371)..(371): a, c, t, g, unknown or other
  modified_base (461)..(461): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtcagtgtgaagtgcactggtggaggtccgggggagacttggtccagccgtgggggtccctgagactctcctgtgtagcctntggtattttgttttagtgactattggatgagtggtccgcaggctcgagggaggggctggagtggtggccaacataaagtacgatgaagtgagataaattattgatntgtgagggcattcaccatctgaggacaacgcaaagaactcgcttgtatctgacaaatggaagagcctagagagccggaaggacacgggtntagtaattattagtgtgtagaagtattacgcgtactacttacgtttagaaccgttaacggtcggggaccgtaacggggtaacccgtcggtacctaacccgttcc

SEQ ID NO: 375196 - DNA, 608 bp, Homo sapiens
  misc_feature: GZ8MTXP02FL1SD.13.28.C06.1.454.CMB.2.raw
  modified_base (220)..(220): a, c, t, g, unknown or other
  modified_base (429)..(429): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccggggganacttggtccaggccgtggggggtccctgagactctcctgtgtagcctctggtattttgttttagtgactattggatgaggttggtccgcaggctccgagggaaggggctggagtgggtggccaacataaagacgatgaagttgagataaattattgactctgtagaggggccattcaccatcgtcgagggacaagcccaaagaactcgntgatctgacaaaagtgggaagacgcctaggagacgggacccggaagggaccacgggacttaggttaattaagtttagtttggtagttcgaagtagtttaacgcgtactaacgttactttggaaccttaacggtcgggggacccaacgggggacccccttggggtacccaccggtttccc

SEQ ID NO: 375197 - DNA, 577 bp, Homo sapiens
  misc_feature: GZ8MTXP02JSQBP.13.28.C06.1.454.CMB.2.raw
  modified_base (264)..(264): a, c, t, g, unknown or other
  modified_base (335)..(335): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggtttccttgttgctattttagaaggtgtccagtgtgaagtgcacctggtggagtccgggggagacttggtccagcctgggggtccctgagactctcctgtgtagcctntggtatttgttttagtgactattggatgagttggtccgcaggctcgagggagggctggagtgggtgccaanataaagtacgatagaagttgagataaattagtttggacttctggtgaggggccagttcaccagtctacggagggaccaacgccaaagaactcggctagtactctagacaaaagtggaagacgccctggagacgcccgggaagaccacgggctaggtatagttatgtgtagacgtagttgcgctacgttacgtttgactaacggcggggtaccacggggtacccctgggtacccacggttccc

SEQ ID NO: 375198 - DNA, 556 bp, Homo sapiens
  misc_feature: GZ8MTXP02HVMU9.13.28.C06.1.454.CMB.2.raw
  modified_base (282)..(282): a, c, t, g, unknown or other
  modified_base (335)..(335): a, c, t, g, unknown or other
  modified_base (370)..(370): a, c, t, g, unknown or other
  modified_base (392)..(392): a, c, t, g, unknown or other
  modified_base (410)..(410): a, c, t, g, unknown or other
  modified_base (431)..(431): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggtttccttgttgctattttagaaggtgtccagtgtgaagtgcacctggtggagtccgggggagacttgggtccagcctggggggtccctgagactctcctgtgtagcctctggtatttgttttagngactattggatgagtggtccgcaggctcgagggagggctggagtgggtgcaanataaagtcgatgagttgagataaattgttggactntgtgaggggccattcaccatcncgagggactaacgccaanaactcgactgtatctgactanagagagctgagagcgaggacgacgcgtgtattattattgttgtgtaggtattaagtcgtactactactttacgtacgtaacgttcgggaccggtacgggaaccgtcggtcgtaccggtttccccg

SEQ ID NO: 375199 - DNA, 704 bp, Homo sapiens
  misc_feature: GZ8MTXP02G6WZ2.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgcttattttagaaggtgtccagtgtgaagtgcacctggtggaggtccgggggagacgttggtccaggccgtgggggtccctgagactctctgtgtagcctctggtattttgttttagtgtacttagttggatgtaggttcgggtccgccgaggcctaccggaggggaacggggcgtagggaggtggggtacggtaccaaaacgaagttaaaacggtacgaagtaggtaaaggtttaggaagtaagttaaaatttagtttaggacttcgtaggtagggacggggtccgtatttccaccctagtaccgtacggaaacgggaaccgaaacccgaccgtaaaacgaaacctccgtacttagtaactcgtagaactaaaagttggggaaagacgtaccgtaggagaacgggccggaaaggtaccgaacggtcttaagtatttagttagtttcgagtacgaagtattacgcgtactaacgtttacttgaacccgttaaggccggggtaccaacggggtaccctcggtacctaacccggtccc

SEQ ID NO: 375200 - DNA, 750 bp, Homo sapiens
  misc_feature: GZ8MTXP02G6VF1.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacgttggtccaggccgtggggggtccctgagactctcctgtgtagcctctggtattttgttttagtgtacttagttggatggtaggttcgggtcccgccgaggccgtccggaggggaaggggcgtgggaggtggggtcggaccaaacgaagtaaaggtacgatagtaaagttgaagtaattaaaagtttagtttaggacttcgttaggtagggtacgggggtcccgtaattaccgaaccctacgttaccgtaccgggaaacgggggaaacccaaacccggacccgaaaaggaaccttcggaccttaggttaacttccgtaggaaccaaaagttcggggaaacgtacgtccgtaagggaacggacgggacccgggtaaagggaacccgacggggtacttaggttaatttaatttaggtttggtggttaagtacggtaatttacgggcctacttaactttacgttggtaaaccgtaaccgggtcgggggacccgtaacggggtaaccccttgggtacccctaccggttccc

SEQ ID NO: 375201 - DNA, 605 bp, Homo sapiens
  misc_feature: GZ8MTXP02HGR2S.13.28.C06.1.454.CMB.2.raw
  modified_base (339)..(339): a, c, t, g, unknown or other
  modified_base (365)..(365): a, c, t, g, unknown or other
  modified_base (399)..(399): a, c, t, g, unknown or other
  modified_base (492)..(492): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccaggccgtggggggtccctggagactctcctgtgtagcctctggtatttgttttagtgactattggatgagttggtccgcaggctcgagggagggctggagtggtgccaanataaagcgatgaagtgagataaattnttggacttgtgtagaggggccgtattccgacctntcgtcggaagggacaacgccaaagactcgctagtactctagacaaaagtggaagagtcccgtaggacgaggacccggaaggaaccgtacggtntagtaattagttagttgtagttagagtacgttacgcgtactacgttacgttagaccgttaacgggtacggggaccgtaaccggggtacccgtcggtacccgtacccgttcccg

SEQ ID NO: 375202 - DNA, 739 bp, Homo sapiens
  misc_feature: GZ8MTXP02I1SFA.13.28.C06.1.454.CMB.2.raw
  modified_base (218)..(218): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggtttccttgtgctattttagaaggtgtccagtgtgaagtgcacctggtggagtccggggganacttggtccaggccgtgggggtccctgagactctcctgtgtagcctctggtattttgttttagtgtacttattggatggaggtttggggtcccgccgaggcctccgaggggaggggctggaggtggggtgccaacaataaagtacgataggaagttgaagattaaaatttagtttagggactttcgtggttagggaacgggggtcccgtaactttccaacccgtattccggttaccgggaaagggggaaacccaaaccggaccccaaaaggaaacccgttcggtaccttaggttacttcgttagaaccgtaaaaagttggggaaagtacgcctagggaagaccgggccggaaagggtacccacggggtcttaggttaaattattttagtttggtaggttaggaacggttatttacgggaccgttacctaaacttttaaccgttttggaaacccgtttaaccgggcggggggtaacccaacgggggtaaccccctttgggtacccgtaaccccggttttccc

SEQ ID NO: 375203 - DNA, 588 bp, Homo sapiens
  misc_feature: GZ8MTXP02FLVQ4.13.28.C06.1.454.CMB.2.raw
  modified_base (220)..(220): a, c, t, g, unknown or other
  modified_base (282)..(282): a, c, t, g, unknown or other
  modified_base (395)..(395): a, c, t, g, unknown or other
  modified_base (398)..(398): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccggggganacttggtccagccgtggggggtccctgagactctcctgtgtagcctctggatttgttttagngactatggatgagttggtccgccaggctccgagggaggggctggagtgggtggccaacataaagtacgatgaagttgagataaattattggactgtgtgagggccattcaccntcncgaggacacgccaagaactgctgtatctgacaaaatggaagagcctggacgagacccggaaggaaccgacgggcttaggtaatatttagttgtgtagagtattacggcgtactacgttaacgtttcgaaccgttaacggtcgggggaccctaacgggggtaacccccttggggtacccacccggtttccc

SEQ ID NO: 375204 - DNA, 809 bp, Homo sapiens
  misc_feature: GZ8MTXP02HDMKJ.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcactggtggaggtccgggggagacgttggtccaggccggtcggggggtccctggacgactctcctgtgtacgcctcgtggtattttgttttagtgtactagttggatgtaggttcgggtccgaccgaggccgtccggaagggggaacgggggtcgtaggggaggttcgggggtcggaccgaaaacgaaagtaaaacggtacgaagtaggtaaaggttagaagtaaattaaatttagtttaggacttgtaggtagggacggggaccgtattaccacctacttccggtacgggaacgggggaaacccaaaccgaaacccgtaaagaaccgtcgtacgttcggttaactccgtagaacctaaaagtcgggaaacgtacgtaccggtaggaaacggccgggaaccgggaagggaacccgtacgggggtacctttaaggttaaagttttaagtttaagggtttgggttagggttaaggtacggtttaaaggtttaccggaccggttaacctttaaccgtttaacgttttccggaaaccgttaaccgggggtacccgggggtacccggtaaccggggtaaaccccgttcggtaaccccggttaacccgtttaccccc

SEQ ID NO: 375205 - DNA, 715 bp, Homo sapiens
  misc_feature: GZ8MTXP02FRMIF.13.28.C06.1.454.CMB.2.raw
  modified_base (689)..(689): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttaaaaggtgcccagtgtgaggtgcagctggtggagtctggaggaggcttgatccagccgtgggggtccctgagactctcctgtgcagtcctcgtggttccaccgtcagtccacacctacatgagcgtcggtccgccgaggctaccggaggggacggggcgtgggagtcggtcgttcgtttctttttatttagtacggttagttacgggtaagttaccattaaccgtccgcgaacgtaccgtccggtaggggacgggggacctacgttaccaaccctacttcccgtacccgaaagaacgtaaactaaacttacccgaaaacgaacctacgggaccctttagttttacccttaaacgaaaagttacgaaaccgtaacgggtccctaaggggaacgaacggacccggataccggaaccgacccggggtacccgtttagttaacgttaccgtgggtaccgaggtaaggtacggtacggtcggggaccccctaaaaggttacccggttaacaaccggtnttacgggtacggacccggttacgggg

SEQ ID NO: 375206 - DNA, 645 bp, Homo sapiens
  misc_feature: GZ8MTXP02JLL2D.13.28.C06.1.454.CMB.2.raw
  modified_base (269)..(269): a, c, t, g, unknown or other
  modified_base (285)..(285): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggtttcctgttgctattttagaaggtgtccagtgtgaagtgcacctggtggaggtccgggggagacttgggtccaggccgtggggggtccctggagactctcctgtgtagcctntggtatttgttttagngactattggatgagttggtccgcaggctccgagggaggggctggagtgggtgaccaacagtaaagcgatagaagttgaagtaattaaattgtttcggacttgtaggttacggaagggggtccctaatttaccgaaactagttccgtacgggaaggggaaacccaaacggacccaaaaggtaacctcggtactgtactcgtagacaaaagtgggaaagcgtccgtaggaacgaggacccgggaaggtaccacgggtcttagtaattagttgttgtagtagaagttacgtacgcgtaccttacgttacgttgacgttaacgggcgggaaccgtaacgggtaccctcggtaccctaccgttcc

SEQ ID NO: 375207 - DNA, 621 bp, Homo sapiens
  misc_feature: GZ8MTXP02I3SAA.13.28.C06.1.454.CMB.2.raw
  modified_base (220)..(220): a, c, t, g, unknown or other
  modified_base (265)..(265): a, c, t, g, unknown or other
  modified_base (280)..(280): a, c, t, g, unknown or other
  modified_base (334)..(334): a, c, t, g, unknown or other
  modified_base (448)..(448): a, c, t, g, unknown or other
  modified_base (500)..(500): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccggggganacttggtccagccgtgggggtccctgagactctcctgtgtgcctntgtatttgttttagngactattggatgaggttggtcccgcgaggctccgagggaggggctggagtgggngccaatataaagacgatagaagttgagaattaattgttggactcgtgtaggacggggtctagttcacctatcgtacggacggggaaccaacgaccaaagaacctcgactgtacnctagacaaagtgggacacggcctaggacgacgaccggaaggccgaacgggtntagtaattagttagttgtagtagagttaccgtaggacctaacgttacgtttacgttaggaaccgttaacgggtaccggggaaccgtaaccgggtaacccgttcggtaccctacccgtaccg

SEQ ID NO: 375208 - DNA, 583 bp, Homo sapiens
  misc_feature: GZ8MTXP02I7DUI.13.28.C06.1.454.CMB.2.raw
  modified_base (281)..(281): a, c, t, g, unknown or other
  modified_base (340)..(340): a, c, t, g, unknown or other
  modified_base (370)..(370): a, c, t, g, unknown or other
  modified_base (443)..(443): a, c, t, g, unknown or other
  modified_base (463)..(463): a, c, t, g, unknown or other
  modified_base (493)..(493): a, c, t, g, unknown or other
  modified_base (502)..(502): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtgggggtccctgagactctcctgtgtagcctctggatttgttttagngactattggatgagttggtccgccaggctccgagggaggggctggaggtgggtgccaanataaagtacgatgaagttgagtataaattnttggactctgtagagggggccattccacctatcgtacggagggacaacggacccaaaggacctcgcgtatacncgttgacaaaatcggggaanacgcgtaggagacggcggaaggacgtcggntagtaattnttagtgtgtgaagtagtacgcgtactacgttacttgaccgttcggacggggacctacggggaccctcggtaccctaccgtc

SEQ ID NO: 375209 - DNA, 625 bp, Homo sapiens
  misc_feature: GZ8MTXP02FPH4H.13.28.C06.1.454.CMB.2.raw
  modified_base (264)..(264): a, c, t, g, unknown or other
  modified_base (280)..(280): a, c, t, g, unknown or other
  modified_base (331)..(331): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattgggtctgaactgggttttccttgttgctattttagaaggtgtccagtgtgaagtgcacctggtggagtccgggggagacttggtccagccgtggggtccctgagctctcctgtgtagcctntggattttgttttagngactattggatgagttggtccgcaggctcgagggaggggctggaggtgggngcaacgataaagtacgatagaagttgagaattaaattagtttaggacttcgtggttaggacggggccgattcacctatcgtcgagggacaacgaccaaagactcgctagtatcgtgacaaaagtggaagacgcctggaagacggacccgggaaggaaccgaccgggtactaggttaattaagtttaattggttggtagaagtactttagggacctactaccgtttaacttgaaccgttaacggtcgggggaccctaacgggggtaacccctcggggtacctaccccggtttccg

SEQ ID NO: 375210 - DNA, 584 bp, Homo sapiens
  misc_feature: GZ8MTXP02F52VJ.13.28.C06.1.454.CMB.2.raw
  modified_base (282)..(282): a, c, t, g, unknown or other
  modified_base (337)..(337): a, c, t, g, unknown or other
  modified_base (373)..(373): a, c, t, g, unknown or other
  modified_base (391)..(391): a, c, t, g, unknown or other
  modified_base (408)..(408): a, c, t, g, unknown or other
tcagtcacgtactacacgaccggtgctcgattagagctcacgtattgggtttgggggaggtctcagagaggagccttagccctggactccaaggcctttccacttggtgatcagcactgagcacagaggactcaccatggaattggggctgaactgggttttcctgttgctattttagaaggtgtccagtgtgaagtgcacctggtggagtccgggggagacttggtccagccgtggggggtccctgagactctcctgtgtagcctctggatttgttttagngactatggatggagttggtccgcaggctcgagggaggggctggagtggtgccaanataaagtacgatgaagttgagtataaatattgactntgtgagggcatcacatcngaggacaacgcaagacncgctagtatctagacaaaagtggaagacgccgtaggacgacgaccgggagaaccgtacgggtctaggttaactagttatttgtgtaacggataacgtttaacggctactaacgttactttgaaactaacggtcgggggacctaaacggggacccttacgggtaccaccggtttccc

SEQ ID NO: 375211 - DNA, 573 bp, Homo sapiens
  misc_feature: GZ8MTXP02IV5RU.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctatttagaaggtgtccagtgtgaagtgcacctggtggagtccgggggagacttggtccagccgtgggggtccctgagactctctgtgtagcctctggtatttgttttagtgactattggatggagttgggtccgcgaggcctcgagggaggggctggagtggtgcaacagtaaagtagatgagttgagataaattgttgactcgtgtgaggggcattcacatctcgaggacacgccaaagaactcgctagtactctagacaaagtggagacgccgtagagacggccggaaggtaccgacggtctaggtaattattagttggtgttacgagtagttacgccgtactacgttactttgaacttaacggtcggggaccctaggggaacccctggtaccaccgttcc

SEQ ID NO: 375212 - DNA, 630 bp, Homo sapiens
  misc_feature: GZ8MTXP02JFM5G.13.28.C06.1.454.CMB.2.raw
  modified_base (267)..(267): a, c, t, g, unknown or other
  modified_base (284)..(284): a, c, t, g, unknown or other
  modified_base (351)..(351): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtggggggtccctgagactctcctgtgtagcctntggtattttgttttagngtactattggatgaggttcgggtccgccgaggcctccggaggggaggggctggagtgggtgccaaanataaagtcgatgtaagttgaagtattaaattagttaggactctaggtagacggggcctaattccaaccagtcgtacggaaggggaaccaaacggacccaaaagaacctcgacttagtactcgtaggaaccaaaagtcgggaaagacgaccgtaggaacggacggacccgggaagggtacccaggggcttaggttaatagtttagtggtagtagacgtatacgcgactacgttacttgaactcggtggggaccaacggggtaccctggaccctaccgtcc

SEQ ID NO: 375213 - DNA, 712 bp, Homo sapiens
  misc_feature: GZ8MTXP02G2E55.13.28.C06.1.454.CMB.2.raw
  modified_base (221)..(221): a, c, t, g, unknown or other
  modified_base (603)..(603): a, c, t, g, unknown or other
  modified_base (705)..(705): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctatttagaaggtgtccagtgtgaagtgcaccgtggtggaggtccggggganacgttggtccaggccgtggggggtccctggacgactctcctgtgtagcctcgtggtattttgttttagtgtacttagttggatgaggttcggtcccgccgaggcctccggaaggggaaggggctggggaggtggggtacgaccgaaaacgtaagttaaaaggtaccgaagtagtaaagttgaaaggtaattaaaatttagtttcggaacttcgtaggtagggaacggggcctaagttaccacctagtcgtacggaagggtaaccaacggaccaaagaacccttcggacgttaggtaattccgtaggaaactaaaaacgtgggaaacgacgggttaccctagggacggacggtaacccggggaggggtaacccaacggggttnttacgttaattagttagttagggtgtaaggtaggtatacgggacctactacttacgttgaaccgtaacggtcgggacccgtacggggtacccgtggtacccnccgtacc

SEQ ID NO: 375214 - DNA, 664 bp, Homo sapiens
  misc_feature: GZ8MTXP02IT8LX.13.28.C06.1.454.CMB.2.raw
  modified_base (265)..(265): a, c, t, g, unknown or other
  modified_base (532)..(532): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcactggtggaggtccgggggagacttggtccagccgtgggggtccctgagactctctgtgtagcctntggtattttgttttagtgtactattggatggaggttggtccgcaggctccgaggggaggggctgggaggtggggtcgaccaacgaagtaaagtacgatagaagttgaagtaataaatttagtttggacttctggtaggaggggcctacttccgacctagtcgtacgggaacggaacaaaccgaccaaagaacctcgacgttagtacttcgtagacaaaagttgggaaagtacgccgtaggacgacggaccggaaggaccgacgggtnttaggttaaattagtttagttggtgtaggtagtaagtttcggccgtacttaaccgtttacgtttacggaaccgttccgggtcgggggtaaccctaaacgggggaaccccttgggtacccaaccccggtttcc

SEQ ID NO: 375215 - DNA, 694 bp, Homo sapiens
  misc_feature: GZ8MTXP02HN9M6.13.28.C06.1.454.CMB.2.raw
  modified_base (187)..(187): a, c, t, g, unknown or other
  modified_base (222)..(222): a, c, t, g, unknown or other
  modified_base (298)..(298): a, c, t, g, unknown or other
  modified_base (549)..(549): a, c, t, g, unknown or other
tcagtcacgtactacacgaccggtgctcgattagagctcacgtattgggtttgggggaggtctcagagaggagccttagccctggactccaaggcctttccacttggtgatcagcactgagcacagaggactcaccatggaattggggctgaacttgggttttccttgttgcttattttagaaggtntcagtgtgaagtgcactggtggaggtccggggganacgttggtccaggccggtcgggggtccctggacgtactctccgtgtgtagtcctcgtggtattttggtttttaagngtacttagttggatggtaggttcgggtcccgacgaggccgtccggaagggggaaggggctggggagggtgggggtacggaccctaaagaagttaaaaggtacgtagtaggtaaaggttagaagtaaatttaaagtttacgtttggaactttgtaggttaggacggggtcctattccactactcgacggacggaaccaacgacccaaagaaccgtcgtacgtagttaatcgtacgaagtaaaagtggggaanacgtccgtagggaaggacgccgggaaagtacccgaggtatgttaattagtttagttggagttagagttacgtacgcttacctaacgttcctttagactccggggtaggacccgtaacgggtacctcggtaaccctccggttaccc

SEQ ID NO: 375216 - DNA, 643 bp, Homo sapiens
  misc_feature: GZ8MTXP02GRVP4.13.28.C06.1.454.CMB.2.raw
  modified_base (403)..(403): a, c, t, g, unknown or other
  modified_base (407)..(407): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtcagtgtgaagtgcacctggtggaggtccggggagacttggtccagccgtggggggtccctggagactctcctgtgtagtcctcggtatttgtttagtgacttatggatgaggttggtccgcgaggctcgaggggagggcgtggaggtgggtgaccaacagtaaagtacgatgaaagttagagtaataaatttgttgactgtgtaggagggctatcacntcgngagggacaacgcaaagactcgctgtactcgtagactaaagtggagacgtccgtaaggaggacgacccgggagggaaccgacgggtcgttagttaaagttagtttaagttggtaggtacgtaaaggtagtttaacggccgttactaaccgtttaacgtttacgtaccggtacgggtccgggggaacccgtaaccgggggtaacccttcggggtaccctaacccggttcctacccccg

SEQ ID NO: 375217 - DNA, 788 bp, Homo sapiens
  misc_feature: GZ8MTXP02JUGXI.13.28.C06.1.454.CMB.2.raw
  modified_base (287)..(287): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcaccgtgggtggaggtccgggggagtacgttggtccaggccgtgggggtccctgagactctctgtgtagcctgtggtatttgttttagngtactagttggatggacggttcgggtccgccgaggcctaccggaggggaaggggtcgtggggacggtggggtcggaccgaaacgtaagtaaaacggtacgagttaggtaaggttagaagtaacttaaagtttagtttacggacttcgtaggtagggacggggtcctagttaccgacctagttccgtacgggaacgggtaaccaaaccggacccaaaaggacctcggtacgttagttaaactcgttagaaacctaaaaggttcgggaaagtccgtaccggtagggaacgggtaccgggaccggggaaacgttaccgaccgggggtttactttaggttaaagtttaggttttacgtttgggaggtttaagggaaggttaccctttacgggacccgtaactttaccgtttaaccggtttttcggaaaaccgttcggggttcccgggggaaaccgttaaccgggggtaaccccctcgggggtttacccccacccggttttacccg

SEQ ID NO: 375218 - DNA, 753 bp, Homo sapiens
  misc_feature: GZ8MTXP02IINZZ.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgctattttagaaggtgtcagtgtgaagtgcaccgtgggtggaggtccgggggatacgttgggtcccaggccgtggggggtccctgagtactctcctgtgtgcctcgtggtattttgttttagtgtactagttggatggtaggttgggtccccgtccgaggtccgtccggaagggggaaggggtcgtggggtaggtggggtaggacctaaacgaagtaaaggtacgagtagaagttagaagtaattaaatttagtttgaacttcgtaggtacgggacggggtcccgtaatttacccaccgtattccggtaacgggaaacggggtaaacccaaaccggacccgaaaacggtaaaccgtccggtacgtttaggtaacttccgttaggaaactaaaaggtggggaaacgtaacgtcccggtaaggacggacggacccgggaggaaccacggggtcttaggttaattagtttagttggagttacggagtatttacggacgtaccttacgttaacgtttggtaaccgttaacgggccgggggtaacccggaacgggttaccccgtcggggtaccctaacccggtttcccc

SEQ ID NO: 375219 - DNA, 603 bp, Homo sapiens
  misc_feature: GZ8MTXP02I7SQL.13.28.C06.1.454.CMB.2.raw
  modified_base (328)..(328): a, c, t, g, unknown or other
  modified_base (461)..(461): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgcttattttagaaggtgtccagtgtgaagtgcacgtggtggaggtccgggggagacttggtccaggccgtgggggtccctgagactctcctgtgtagcctcgtggtattttgttttagtgactattggatgaggttggtccgcaggctcgagggagggntggaggtggtgacaacagtaaagtcgatagaagttgagtaattaaattagtttcggacttgtgtagaggggcctatcaccatcgtgagggacaaacgcaaagactcgcttagatcgtagacaaaagtgggaanacgcctaggaagacgccggaaaggtaccgacgggtatagttaatagtttacgttggtagtaggtaagttaccgtagcgacttacgtttacttgacgttaacggcggggtaccaacggggaacctcggtaccgtacccgttcc

SEQ ID NO: 375220 - DNA, 790 bp, Homo sapiens
  misc_feature: GZ8MTXP02H0BEF.13.28.C06.1.454.CMB.2.raw
  modified_base (223)..(223): a, c, t, g, unknown or other
tcagtcacgtactacacgaccggtgctcgattagagctcacgtattggggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctgggtggaggtccggggganacttggtccaggccgtcggggggtccctgacgactctcctgtgtacgcctctggtattttgtttttagtgtacttagttggatggtaggttcggggtcccgaccgacggccgtccggaggggaagggggcgtggggtaggtgggggtcggaccgaaaacgtaagttaaaacggtacggaagttaggtaaaggtttaggaacgttaaatttaaaaagttttagtttttacgggtaaccgtttcggtttaggttacggggaacgggggtacccgtaaacgttttaccgaaaacgtacgtttccggaccggggaaacgggtaaacccaaaccgacccgaaagtaacccgtccgacgttaggttaccttcgtagaacgtaaaagtgggaaacgtgacccgtaggacggaggacccgggaggtaaacccgcgggtactttaggttaattagtttagttgggtagttaggaacgttattacgggccttaacgtacctttaacgtttggaaaccttaacggggtccgggggacctaaaccgggggacccctttacggtccctaaccccggtccc

SEQ ID NO: 375221 - DNA, 586 bp, Homo sapiens
  misc_feature: GZ8MTXP02IAYCH.13.28.C06.1.454.CMB.2.raw
  modified_base (133)..(133): a, c, t, g, unknown or other
  modified_base (200)..(200): a, c, t, g, unknown or other
  modified_base (334)..(334): a, c, t, g, unknown or other
  modified_base (346)..(346): a, c, t, g, unknown or other
  modified_base (399)..(399): a, c, t, g, unknown or other
  modified_base (425)..(425): a, c, t, g, unknown or other
  modified_base (448)..(448): a, c, t, g, unknown or other
  modified_base (490)..(490): a, c, t, g, unknown or other
tcagtcacgtactacacgaccggtgctcgattagagctcacgtattgggtttgggggaggtctcagagaggagccttagccctggactccaaggcctttccacttggtgatcagcactgagcacagaggactnaccatggaattggggctgaactgggttttccttgttgctattttagaaggtgtccagtgtgaagtgnactggtggagtccggggagacttggtcagccgtgggggtcctgagactctcctgtgtagcctcgtggtatttgttttagtgactattggatgagtggtcgccaggctcgagggagggctggagtggtgccaaanataaagtacgangaagttgagtaataaaattacttggactgtggtgagggcctattcaccgatcngacgggacaacgacaagtaactccgntggtaatctagaccgtaaaaggnggaacgtcgcgtaggaagacgaccgggaaggacgaccggttntagttaatagttagttgtgtgaagttatacgcactaacttacgttacgacgtaacggcggggaccgtacgggtaacccgtcggtaccgtacccgtc

SEQ ID NO: 375222 - DNA, 614 bp, Homo sapiens
  misc_feature: GZ8MTXP02GRS9W.13.28.C06.1.454.CMB.2.raw
  modified_base (170)..(170): a, c, t, g, unknown or other
  modified_base (341)..(341): a, c, t, g, unknown or other
  modified_base (348)..(348): a, c, t, g, unknown or other
  modified_base (369)..(369): a, c, t, g, unknown or other
  modified_base (385)..(385): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgntattttagaaggtgtccagtgtgaagtgcacctggtggagtccgggggagacttggtccagcctggggggtccctgagactctcctgtgtagcctctggatttgttttagtgactattggatggagttcgggtccgccgaaggctccgaagggaaggggctggagtggggngacaaanaataaagagatagaagtaganaataaattatagactntgagaggcatcacatcacgaaggaaacaaacgtaccaaaagaaactacgacgtagtactactacgaacgaaagtaaggaaggaacgacgtacgtaagacggaccggaacggaacgacggacgtagtaataattaagttagtagtagtagtaagtaagtacgacgtacttaacgttacgtaacgtaacgtacgggacggaacggtaaccgtacggtaccgtaccgtaccg

SEQ ID NO: 375223 - DNA, 770 bp, Homo sapiens
  misc_feature: GZ8MTXP02H74K3.13.28.C06.1.454.CMB.2.raw
tcagtcacgtactacacgaccggtgctcgattagagctcacgtattgggtttgggggaggtctcagagaggagccttagccctggactccaaggcctttccacttggtgatcagcactgagcacagaggactcaccatggaattggggctgaacttgggtttccttgttgctatttagaaggtgtccagtgtgaagtgcacctgggtggaggtccgggggagacttgggtccaggtccgtggggggtccctggacgtacctctcctgtgtacgcctcgtcgggttcaccgtcacgtcacacctacatggagtccgtcgggtcccgccgacgggcctaccggagggggacggggccgtagggagtggtccgtttacgtttcgttttttaatttacgttaggttaggtaggtaagtacccgtaactaccgtacccaacgacgtaccgttccggtcgggggacgggggtaccctacgttacccaacccgtagttacccgttaccgaaacggttagaaacccttaaactttaacccggaaaacgtaaacccgtaccgttcgttttaacgtttcccttaaacaaagttcgaaaactcggtccgtaagacggtacgaccgtaacgtacggaccggtaccgggtccgtttaagtacttaccgtggtacggacgtaaacgggacggtacgggtcccgggggaacccacggttaaaacccgtttcgaacggtctaggttacggggccgttacgggtcgggaacccgaacgggtaccccg

SEQ ID NO: 375224 - DNA, 465 bp, Homo sapiens
  misc_feature: GZ8MTXP01ADL1I.25.12.B01.1.454.CMB.2.raw
  modified_base (398)..(398): a, c, t, g, unknown or other
  modified_base (439)..(439): a, c, t, g, unknown or other
  modified_base (454)..(456): a, c, t, g, unknown or other
  modified_base (458)..(465): a, c, t, g, unknown or other
tcagactgtacagtcacgaccggtgctcgatttagtagtgtagattccgcgggatgttgtgatgactcagtctccactctccctgcccgtcgcccttggacagtcggtctccttctcctgcaggtctagtcacaacctcgtacacagtgatgggaacacctacttgaattggtttcagcagaggccaggccaatccccaaggcgcctaatctataaggcttctaaccgggactctggggtccccgacagattcagcggcagtgggtcaggcactgattcacactgaaatcagcaggtggagctgagatgttgggtttatactgcatgcaaggtcacacctggccttcactttcggccctgggaaccaaagtgatatcaaagactgtgctgcaccatcntcttcactcttcccgccactctcggactgtctacgtctggngcggcgcgcgagcgnnngnnnnnnnn

SEQ ID NO: 375225 - DNA, 479 bp, Homo sapiens
  misc_feature: GZ8MTXP01D41D0.25.12.B01.1.454.CMB.2.raw
  modified_base (248)..(248): a, c, t, g, unknown or other
  modified_base (470)..(470): a, c, t, g, unknown or other
  modified_base (473)..(479): a, c, t, g, unknown or other
tcagactgtacagtcacgaccggtgctcgatttagtagtgtagattccgcggggatgttgtgatgactcagtctccactctccctgcccgtcgcccttggacagtcggcctccttctcctgcaggtctagtcacaacctcgtacacagtgatgggaacacctacttgaattggtttcagcagaggccaggccaatccccaaggcgcctaatctataaggcttctaaccgggactctggggtccccganagattcagcggcagtgggcaggcactgattcacactgaaaatcagcagggtggaggctgaggattgttgggggtttattactgcatgacaaggtacacacctggcttccactttcggccctgggaaccaaagtggatatacaaacgaactgtagctgcaccatctgtcttcatcttcccgcatctaggtaactgtacagtctgacgcggctggcaaggcganaannnnnnn

SEQ ID NO: 375226 - DNA, 621 bp, Homo sapiens
  misc_feature: GZ8MTXP01AY403.25.12.B01.1.454.CMB.2.raw
  modified_base (256)..(256): a, c, t, g, unknown or other
  modified_base (603)..(605): a, c, t, g, unknown or other
  modified_base (607)..(609): a, c, t, g, unknown or other
  modified_base (611)..(621): a, c, t, g, unknown or other
tcagactgtacagtcacgaccggtgctcgatttagtagtgtagattccgcggggatgttgtgatgactcagtctccactctccctgcccgtcgcccttggacagtcggcctccttctcctgcaggtctagtcacaacctcgtacacagtgatgggaacacctacttgaattggtttcagcagaggccaggccaatccccaaggccgacctaatctaataaggcttacgtaaccgggactcgtcgggggtccccganagattcgagcggcaggtgggtcaggcactgtacttcacactagaaaatcagcgaagggtggaggcgtagaggtattggtttagggggtttattacgtgcagtgacgaaaggtacaacgtaccgtcggtaccttccgtaccgtttcccgggaaccccgttaggggaaccctaaaagggtcgggtaaattaacgtaaccgaaaacggtaacgtggtacggactacggaccacctacttcgttacgttctttaccacttcccttaccccgctaacttccgtacggtaacgttgttaacctacgttcgtggacggcggggtaccgtgggaccgaagggccgacgaagtcgnnngnnngnnnnnnnnnnn

SEQ ID NO: 375227 - DNA, 495 bp, Homo sapiens
  misc_feature: GZ8MTXP02HOQ66.25.12.B01.1.454.CMB.2.raw
  modified_base (398)..(398): a, c, t, g, unknown or other
  modified_base (429)..(429): a, c, t, g, unknown or other
  modified_base (481)..(481): a, c, t, g, unknown or other
  modified_base (484)..(495): a, c, t, g, unknown or other
tcagactgtacagtcacgaccggtgctcgatttagtagtgtagattccgcggggatgttgtgatgactcagtctccactctccctgcccgtcgcccttggacagtcggcctccttctcctgcaggtctagtcacaacctcgtacacagtgatgggaacacctacttgaattggtttcagcagaggccaggccaatccccaaggcgcctaatctataaggcttctaaccggggactcgtcggggtccccgacagattcagcggcagtgggtcaggcactgatttcacactagaaaatcagcagggtggaggctgaggatggttggggtttattactgcatgcaaggtacacactgccttcactttcggcctgggaccaaagtgatatacaaacgactgngctgcaccatcttagtcttcactccttcccncaattcgtagtaacttgtaactagtctgaggcgggctggaccaggcacgtanagnnnnnnnnnnnn

SEQ ID NO: 375228 - DNA, 487 bp, Homo sapiens
  misc_feature: GZ8MTXP02F8DD5.25.12.B01.1.454.CMB.2.raw
  modified_base (402)..(402): a, c, t, g, unknown or other
  modified_base (420)..(420): a, c, t, g, unknown or other
  modified_base (429)..(429): a, c, t, g, unknown or other
  modified_base (476)..(487): a, c, t, g, unknown or other
tcagactgtacagtcacgaccggtgctcgatttagtagtgtagattccgcggggatgttgtgatgactcagtctccactctccctgcccgtcgcccttggacagtcggcctccttctcctgcaggtctagtcacaacctcgtacacagtgatgggaacacctacttgaattggttcagcagaggccaggccaatccccaaggcgcctaatctataaggcttctaaccgggactctggggtccccacagattcagcggcagtgggtcaggcactgattcacactgaaaatcagcagggtgaggctggaggatggttggggtttatacgtgcatgacaaggtacacacctggccttccacgtttcggcccttgggacctaaagtggatactacgaaacgactgngctgcaccatctgtcttnactctcccnctatctagtaactgtacagtctgagcggctggacaaggcgacatagnnnnnnnnnnnn

SEQ ID NO: 375229 - DNA, 479 bp, Homo sapiens
  misc_feature: GZ8MTXP02IQLGQ.25.12.B01.1.454.CMB.2.raw
  modified_base (467)..(467): a, c, t, g, unknown or other
  modified_base (473)..(479): a, c, t, g, unknown or other
tcagactgtacagtcacgaccggtgctcgatttagtagtgtagattccgcggggatgttgtgatgactcagtctccactctccctgcccgtcgcccttggacagtcggcctccttctcctgcaggtctagtcacaacctcgtacacagtgatgggaacacctacttgaattggtttcagcagaggccaggccaatccccaaggcgcctaatctataaggcttctaaccgggactctggggtccccgacagattcagcggcagtgggtcaggcactgatttcacactgaaaatcagcagggtggaggctgaggatggttggggtttattactgcatgcaaggtacacactggccttccactttcggcccttgggaccaaagtggatatacaaacgaactgtgctgcacatctgtcttcatccttcccgcctatctgaactgtacagtctgacgcgggctggcaaggcncatagnnnnnnn

SEQ ID NO: 375230 - DNA, 681 bp, Homo sapiens
  misc_feature: GZ8MTXP02G6LIW.25.12.B01.1.454.CMB.2.raw
  modified_base (672)..(672): a, c, t, g, unknown or other
  modified_base (675)..(675): a, c, t, g, unknown or other
tcagactgtacagtcacgaccggtgctcgatttagtagtgtagattccgcgggatgttgtgatgactcagtctccactctccctgcccgtcgcccttggacagtcggcctccttctcctgcaggtctagtcacaacctcgtacacagtgatgggaacacctacttgaattggtttcagcagaggccaggccaatccccaaggcgcctaatctataaggcttctaaccgggactcgtcggggtccccacagattcagcggcagtggggtcaggcactgatttcacactgaaaatcagcagggtggaggctggaggattggtttaggggtttattacgtgactatggactaaggtacacgaccgtggtaccttccgactttccgggaccccgttaggggaccctaaaagggttcgggaaacttacgtaaccgtaaaacggtaacgtggttacggggccttacggacctacccgtatttaccgtcggttccctttcgtaacgtttcccttccccgtacctaaacgttccgttacggaaaacctttcggtaaccgtaacggttaccgttggtaacggcccggggggtacttcgggggaaccggtaaacggggtccccggtaaacgtaacgttacggagacgtacgtacgtacgtacgcgacgaagacgacgtacanacncactcg

SEQ ID NO: 375231 - DNA, 626 bp, Homo sapiens
  misc_feature: GZ8MTXP01A9MRI.51.82.H05.1.454.CMB.2.raw
tcagcgatcgtatacacgaccggtgctcgatttagtcgagctctctcgcggggtcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatcctctgcacgtgggaacagttccaaacagtcggggcaggttataatgtacactggtaccagcaactcaggaacacgacccccaaatcctcatccatgaataccagaaactcggcccgtcgggggtccccctgacgtattctcgtcggcctcgaaagtcctagactaccttcgacgtccctccgtcgcctactccacgttcgggcctaccgagtaccgtggaggatggacggctaggtaaccttattacgtcgaccctacggttccctaagtcgaaaccgacgacgaggtctacggttacgttcggttcggtttcgggtttcggggtttccgggggccggggacccggggtaaccgtacggtccggttaccggtaccccggttacccggttaacgggttaacccgaacccgg

SEQ ID NO: 375232 - DNA, 471 bp, Homo sapiens
  misc_feature: GZ8MTXP01C74MW.51.82.H05.1.454.CMB.2.raw
  modified_base (238)..(238): a, c, t, g, unknown or other
  modified_base (256)..(256): a, c, t, g, unknown or other
  modified_base (372)..(372): a, c, t, g, unknown or other
  modified_base (374)..(374): a, c, t, g, unknown or other
  modified_base (376)..(376): a, c, t, g, unknown or other
  modified_base (379)..(380): a, c, t, g, unknown or other
  modified_base (382)..(383): a, c, t, g, unknown or other
  modified_base (386)..(386): a, c, t, g, unknown or other
  modified_base (388)..(389): a, c, t, g, unknown or other
  modified_base (391)..(391): a, c, t, g, unknown or other
  modified_base (395)..(396): a, c, t, g, unknown or other
  modified_base (398)..(398): a, c, t, g, unknown or other
  modified_base (400)..(400): a, c, t, g, unknown or other
  modified_base (403)..(404): a, c, t, g, unknown or other
  modified_base (409)..(410): a, c, t, g, unknown or other
  modified_base (412)..(412): a, c, t, g, unknown or other
  modified_base (418)..(420): a, c, t, g, unknown or other
  modified_base (424)..(424): a, c, t, g, unknown or other
  modified_base (426)..(428): a, c, t, g, unknown or other
  modified_base (431)..(431): a, c, t, g, unknown or other
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaanatcggggcaggttataangtacactggtaccagcaacttcaggaacagccccaaatcctcatccatgataccagaaactcggcctcgggggtccccctgaccgattctctggctccaagtctgacacttcgacncncngcnncnngcncnncngagnngngngtnntatanncnctctannnagcngnnntgngtgtgttcggttcggcggcgacgcgcgcgttcgtcgcgcg

SEQ ID NO: 375233 - DNA, 502 bp, Homo sapiens
  misc_feature: GZ8MTXP01CKQ4R.51.82.H05.1.454.CMB.2.raw
  modified_base (181)..(181): a, c, t, g, unknown or other
  modified_base (206)..(206): a, c, t, g, unknown or other
  modified_base (382)..(382): a, c, t, g, unknown or other
  modified_base (386)..(386): a, c, t, g, unknown or other
  modified_base (390)..(390): a, c, t, g, unknown or other
  modified_base (395)..(395): a, c, t, g, unknown or other
  modified_base (449)..(449): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctnttcttggtggcagcaaccacaggancccactcccaggtgcagctggtgcagtctggggactgaggtgaagagcctggggcctcgagtgaaggtctcctgcaagacttctggatacaccttcaccgactactatatgcacgtgggtgccgacaggcccctggacaaagggcttgagtggatgggatggatcgactagatggnccanaacntgcanagtactttgagggtctgggtcaccagtcgaccgagcgaacacattcagcaaacncagtacacgagtggagttcgacctaagcctgaccgcacggtccgttgtttaag

SEQ ID NO: 375234 - DNA, 499 bp, Homo sapiens
  misc_feature: GZ8MTXP01DJRY9.51.82.H05.1.454.CMB.2.raw
  modified_base (259)..(259): a, c, t, g, unknown or other
  modified_base (431)..(431): a, c, t, g, unknown or other
  modified_base (450)..(450): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaacatcggggcaggttanaatgtacactggtaccagcaaacttcaggaacagcccccaaactcctcatccatgactaccagaaatcccggccctcgggggtccctgaccgaattctctgctccaagtctgacacttcagcctccctgccatcactggctcagactgagatgaggctgactatactgaccngtcctatcgcaagcaggcngacctgccgttgttcggtttcggcggcgggaccaggctgaacccgtccg

SEQ ID NO: 375235 - DNA, 499 bp, Homo sapiens
  misc_feature: GZ8MTXP01A6H2W.51.82.H05.1.454.CMB.2.raw
tcagcgatcgtatacacgaccggtgctcgatttagtcgagctctctcgcggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatcccatgataccagaaactccggccctcgggggtccctgaccgaattctctggctcagtctgacacttcagcctcctggccatcactgggctcccagactgaggagtgaggctgactattactgcacgtcctatgcaagcaggcttgctgcgttgttggtttcggtcggcgggcgacgcgtcgaacgtccg

SEQ ID NO: 375236 - DNA, 499 bp, Homo sapiens
  misc_feature: GZ8MTXP01DYI5Z.51.82.H05.1.454.CMB.2.raw
  modified_base (258)..(258): a, c, t, g, unknown or other
  modified_base (344)..(344): a, c, t, g, unknown or other
  modified_base (413)..(413): a, c, t, g, unknown or other
  modified_base (433)..(433): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaaacatcggggcaggttataangtacactggtaccagcaacttccaggaacacgcccccaaatcctcatccatgaataccagaaactcggcccgtcggggtccccccngaccgatctctcgctccaagtctgacacttcagtccctcctgcatcactggctcagactgagatgaggntagatatactgcagtctatnacagcaggctgactgttcgtggtggtttcggcggcggaaccagcgtgccgttctaagttcgaaccg

SEQ ID NO: 375237 - DNA, 499 bp, Homo sapiens
  misc_feature: GZ8MTXP01DI0VB.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaacatcggggcaggttataatgtacactggtaccagcaaacttccaggaacacgacccccaaactcctcatccatgataccagaaactcccggccctcgggggtccctgaccgaattctctggctccaagtctgacacttcagcctcctgccatcactggctccagactgagagtgaggctgactatactgaccagtcctatcgacaagcaggcttgactgcgttggttggtttcgggcggcggacagctcgccgtcg

SEQ ID NO: 375238 - DNA, 675 bp, Homo sapiens
  misc_feature: GZ8MTXP01BEXU7.51.82.H05.1.454.CMB.2.raw
  modified_base (187)..(187): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctnagtgtcgtcggggccccagggcaggaggtcaccatctcctgcacgtgggaacagttccaacagtcgggacaggttataagtgtacacgtggtaccagacaaacttccaaggaaccaccgacccccaaactccctacactccatacgaactaaccagaaacgtcccccggaccccggttcgggggtcccctacggtacccgtaactttcctcgtcggtaccctacccgtaaacgttcctacgacctaccttccaaccgtccccttcccgtcggaccctaactccgaccgttcgggacctacccgaagacgtaggaacggtagtacggaggtacctacgtaacttacttacgcgtaccctacgttacccttaagtacgacaacgcgttacggtcgttacggtacgttcgttcggtttcgggtttccggggttccggggaccgggtaaccgggaaccgtacggttccgttaaccggttaacccggttaacg

SEQ ID NO: 375239 - DNA, 497 bp, Homo sapiens
  misc_feature: GZ8MTXP01CMCS8.51.82.H05.1.454.CMB.2.raw
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacacgcccccaaactcctacatccatgataccagaaatcggccctcgggggtccccctgaccgattctctggctccaagtctgacacttcacgcctccctgccatcactgggctccagactgagatgaggctgactatactgcagtcctatgacagcaggctgactgctgtggtttcggcggcggaacagctgaccgttctaacggttcaacg

SEQ ID NO: 375240 - DNA, 545 bp, Homo sapiens
  misc_feature: GZ8MTXP01EGS3T.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaaacatcggggcaggttataatgtacactggtaccagacaacttccaggaaaccacgacccccaaatccctacactccaatgaactaccagaaactcggacccgtcgggggtcccccctgaccgtattcctctcgcctcgaagtctgacacttcacgtccctcctgccatcacgtggcctaccagactgacgatgacggctagacttattactgcctacgtacctatcgacagcgaggctgactgctagttcgggtttcggcgggttcgggaaccagtcgtacggtacccgttcgtaacggttcaacgg

SEQ ID NO: 375241 - DNA, 492 bp, Homo sapiens
  misc_feature: GZ8MTXP01CICLC.51.82.H05.1.454.CMB.2.raw
  modified_base (424)..(424): a, c, t, g, unknown or other
  modified_base (490)..(490): a, c, t, g, unknown or other
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatccatgataccagaaatcggccctcgggggtccccctgaccgattctctggctccaagtctgacacttcagccctccctggccatcactgggctccagactgagatgagctgactattacngccagtcctatgacagcaggctgactgctgtggtttcggcggcggaacagctgacttctaagttcncg

SEQ ID NO: 375242 - DNA, 495 bp, Homo sapiens
  misc_feature: GZ8MTXP01B3WGO.51.82.H05.1.454.CMB.2.raw
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgagaagctgggcctcagtgaaggtctcctgcaagacttctggatacaccttcaccgactactatatgcactgggtgccgacaggcccctggacaaagggcttgagtggatgggatgggatcgaccctaagaatggtgccacaaactatgcacagactttcagggctgggtcaccatgaccagcgacacatctagcaacacagtcttacatggagttgaccaagcctgaccgacacggccgttgtttaag

SEQ ID NO: 375243 - DNA, 574 bp, Homo sapiens
  misc_feature: GZ8MTXP01AKJO8.51.82.H05.1.454.CMB.2.raw
  modified_base (258)..(258): a, c, t, g, unknown or other
  modified_base (476)..(476): a, c, t, g, unknown or other
  modified_base (482)..(482): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaacagtcggggcaggttataangtacactggtaccagacaacttccgaaggaaccacgaccccccaaaactccctacactcccatgaataccagaaactccggcccgtcggggtcccccctgaccgattcctctcggcctccaagtctgacctacttcacgtccctccctggccactcacgtcgggacctccgagactgacggatgaggctgacttatactcgcctaggtcctatcgacncgacgnggctagcctgccgttggttcgggttttccgggccgggaccggggtaaccacggtcctacgggtacccgttccgtaacggttccgaacccggg

SEQ ID NO: 375244 - DNA, 575 bp, Homo sapiens
  misc_feature: GZ8MTXP01BMSOA.51.82.H05.1.454.CMB.2.raw
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacacgcccccaaactcctcatccatgataccagaaactcggccctcgggggtccccctgaccgatctctggcctccgaagtctagactacttcacgccctccctgccatcacgtgggcctccagacctgacggatggaggctagtacttacttacgtcgtcccgtaagtccctaatcgtaaccaggccaaggggtccttgaccgttgttccgttggttcgggttttccgggcgggttaccggggaacccaaggtcctcgggtaacccgttcggtaacggttccgaacccgg

SEQ ID NO: 375245 - DNA, 566 bp, Homo sapiens
  misc_feature: GZ8MTXP01DPCKB.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagagggtcaccatctcctgcacgtgggaacagttccaaacagtcggggcaggttataatgtacactggtaccagcaacttcaggaaacacgacccccaaactcctacactccatcgaactaccagaaactccggacccgtccgggggtccccctcggaccgtattcctcgtcggcctcccgaaagtcctacgacctaccttcacgtcccctcccgtggccactcacgtgggcctcagacgtgagatagaggtctagtacttattacgtgcctagtacctagtcgacagcaggctgacgtgttcgttggttcgggtttcggcgggttcggaacagtcgtcgaccgttcgtaacggttcgaaccg

SEQ ID NO: 375246 - DNA, 501 bp, Homo sapiens
  misc_feature: GZ8MTXP01BQAUY.51.82.H05.1.454.CMB.2.raw
  modified_base (260)..(260): a, c, t, g, unknown or other
  modified_base (321)..(321): a, c, t, g, unknown or other
  modified_base (377)..(377): a, c, t, g, unknown or other
  modified_base (381)..(381): a, c, t, g, unknown or other
  modified_base (442)..(442): a, c, t, g, unknown or other
  modified_base (473)..(473): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgagtgaagagctgggctnagtgaaggtctcctgcaagacttctggatacaccttcaccgactactatatgcactgggtnccgacaggcccctggacaaagggcttgagtggatgggatggatcgacctaagatgngcanaaactatgacacagtactttcgagggcgtgggtcaccatcgaccaggcacactatcgtacncaaacacgatcttacagtggagttcgaaccngcctaacgaccgacgacggtcgttgttg

SEQ ID NO: 375247 - DNA, 550 bp, Homo sapiens
  misc_feature: GZ8MTXP01B8OCE.51.82.H05.1.454.CMB.2.raw
  modified_base (236)..(236): a, c, t, g, unknown or other
  modified_base (488)..(488): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacngttccaacagtcggggcaggttataatgtacactggtaccagcaaactccaggaacacgacccccaaactcctcatccatcgataccagaaactccccggcccctcgggggtccctgacccgtaagttcctcgtcgggcctacccaagtcctagacctacttcacgccctcccgtcggcccatccacgtgggcctccgagactgacggagtggaggtctagacttacttacgtgccctagtccctatcgacngcaggcttgactgttcgttggttcgggtttcggcggtcgggacctaggcctgcccgtaaccg

SEQ ID NO: 375248 - DNA, 530 bp, Homo sapiens
  misc_feature: GZ8MTXP01DEB6G.51.82.H05.1.454.CMB.2.raw
  modified_base (301)..(301): a, c, t, g, unknown or other
  modified_base (360)..(360): a, c, t, g, unknown or other
  modified_base (437)..(437): a, c, t, g, unknown or other
  modified_base (448)..(448): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcactgggaacagttccaacagtcggggcaggttataatgtacactgtacagcaactcaggaacacgacccccaaatccncatccatgaactaaccagaaactccggcccgtccgggggtcccccctggaccgattccncgtcgcctccaaagtctgacaccttcacgccctccctgccatcactggctccagactgagatgagctgactattacngccagtcctangacagcaggctgactgcgttggttcggtttcgggcggttaccgggaaccaagcgtcgaccgttccgtaacggttcgaaccgg

SEQ ID NO: 375249 - DNA, 516 bp, Homo sapiens
  misc_feature: GZ8MTXP01ELDN2.51.82.H05.1.454.CMB.2.raw
  modified_base (243)..(243): a, c, t, g, unknown or other
tcagcgatcgtatacacgaccggtgctcgatttagtcgagctctctcgcggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaanatcggggcaggttataatgtacactggtaccagcaacttccaggaacacgacccccaaatcctcatccatgaactaccagaaactccccggcccgtcgggggtccctgacccgtaattctcgtgcctaccaagtctcgactacttcacgccctcctgccatcactggctcagctagagagtggaggtctgactattactcgacctagtcctagtcgacaagcaggcttgactgcgttggttcggtttcggcggtcggacagccgtcgccgtcg

SEQ ID NO: 375250 - DNA, 546 bp, Homo sapiens
  misc_feature: GZ8MTXP01EM9IO.51.82.H05.1.454.CMB.2.raw
  modified_base (467)..(467): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggaacagttccaacagtcggggcaggttataatgtacactggtaccagcaacttccaaggaaaccacgacccccaaatcctacactccaatgaactaccagaaacgtccggacccgtcgggggtccccctggaccgtattcctctcggcctccaagtctgactacttcacgtccctccctgccatcacgtggcctcagactgagatgagcgtgacttattactcgccacgtcctatcganacgcaggctgactgcgtggttcggtttcgggcggttcgggaacacgtcgtcggtaccgttccgtaacggttcgaacccg

SEQ ID NO: 375251 - DNA, 581 bp, Homo sapiens
  misc_feature: GZ8MTXP01BTFTW.51.82.H05.1.454.CMB.2.raw
  modified_base (207)..(207): a, c, t, g, unknown or other
  modified_base (261)..(261): a, c, t, g, unknown or other
  modified_base (270)..(270): a, c, t, g, unknown or other
  modified_base (280)..(280): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggancccactcccaggtgcagctggtgcagtctgggactgaggtgaagagctgggctnagtgagtcnctgcagactngatacaccttcaccgactactatatgacacgtgggtcaccgaccacggccccgtggaaccgaaagggtcttggagtggagtggggactggggactaccgaaccctaaagaagtgggtacgacccaaactaaaaccttagtcgacctaacgacgtacttttacgagggtccgtcggggttaccaaccgagtacgaaccgacgaccgaaccactattccgaacgcaaacacgttacgtaccagtaagtggttacgttcgaacccgtgcccgtaagacccgacgaccgggtccgttgttttaag

SEQ ID NO: 375252 - DNA, 606 bp, Homo sapiens
  misc_feature: GZ8MTXP01DK5EX.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactgaggtgaagacgcgtggggcctcgagtgaaggtctcctgacaagacttctggactaccaccttacaccgtactactatatgctacgtgggtcgacccgacgacggcccctaggaaccgaaacggggtcttggaggtgggagtggggatgggactacgaaccctaagaagtggtcgaccaaactaaactagtcgacacgacgttacttttacgagggtcggttcgggtacaaccgagtacgaccgagaccgaactacattacgacgacaaacgacgttacgttaccttaagagtagggttacgttcgaaccgtaacggacccgtcggaacccggacgttaccgggttccgtttaagtttttaag

SEQ ID NO: 375253 - DNA, 549 bp, Homo sapiens
  misc_feature: GZ8MTXP01CVMFG.51.82.H05.1.454.CMB.2.raw
  modified_base (181)..(181): a, c, t, g, unknown or other
  modified_base (199)..(199): a, c, t, g, unknown or other
  modified_base (204)..(204): a, c, t, g, unknown or other
  modified_base (415)..(415): a, c, t, g, unknown or other
  modified_base (421)..(421): a, c, t, g, unknown or other
  modified_base (475)..(475): a, c, t, g, unknown or other
  modified_base (483)..(483): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctnttctggtgcagcaaccanaggancccactcccaggtgcagctggtgcagtctggggactggaggtgaagaagccgtggggcctcgagtgaaggtctcctgacaagacttcgtggaactactacccttcaaccgactaactatatgcacgtgggtcgacccgacgacggcccctggaaccgaaagggtcttggagtggagtgggatggactcgaacctaagaagtggagaccaanaaactntgacacagtactttgagggtcgtgggtcaccgagtcgaccagcaacatatcganacaaacanagttacacgtagtggttagttcgacccaagcccgtgacccgacgttaccgggtccgttgttttaag

SEQ ID NO: 375254 - DNA, 565 bp, Homo sapiens
  misc_feature: GZ8MTXP01EXPU8.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactccccaggtgcagctggtgcagtctgggactgaggtgaagagctgggcctcagtgaaggtctcctgcaagtacttctggatacaccttcaccgtactactatatgcacgtggggtcgcccgacgacggccccgtaggacgaaaaggggtcttggagtgggatggggatgggactccggaaccctaaagaacgtgggtacgaccaaactaaaactatcgacaacgagtactttacgaaggggtcgtggggtaccaacctagtcgaaccagacgaacactatacagacaaacacagtacttacgagtggagttcgaccaagcctaacgacccgacgaccgggtccgttgtttaag

SEQ ID NO: 375255 - DNA, 614 bp, Homo sapiens
  misc_feature: GZ8MTXP01B5KP4.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagaggtcaccatctcctgcacgtgggaacagttccaaacagtcggggctaggttataatgtacactggtaccagacaacttccgaaggaaccacgacccccaaactccctacactccatagaactaaccaagaaacgtccggcccgtccgggggtcccccctaggaccgtattcctcgtacggcctccaagtcctagacctacttcacgtccctcctgccctatccacgtcgggacctaccagaccgtaggagataggacggtactaggtacttaacttacgtcgacctagttacctagtcgaacgacgcagggctacgaccgttggttcgttcgggtttcgggtttccggggcgggaccgggtaacccaaggtccgtacggacccgttccggtaacggttccgaacccgg

SEQ ID NO: 375256 - DNA, 528 bp, Homo sapiens
  misc_feature: GZ8MTXP01BT0SY.51.82.H05.1.454.CMB.2.raw
  modified_base (258)..(258): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctgggccccagggcagaggtcaccatctcctgcactgggaacagttccaacagtcgggcaggttanaatgtacactggtaccagcaacttccaggaacacgacccccaaactccctcactccatcgataccagaaactccccggcccgtcgggggtccctgacccgaattcctcgtggcctaccagtcctgactacttcacgtccctcccgtcggccatccgacgtcgggcctccgagacgtgacggagtggaggctgacttatactcgaccagtcctatgacaacgcagcttgactgcgttgttcggtttcggcggcggacgagctcgccgtccg

SEQ ID NO: 375257 - DNA, 527 bp, Homo sapiens
  misc_feature: GZ8MTXP01D468B.51.82.H05.1.454.CMB.2.raw
  modified_base (260)..(260): a, c, t, g, unknown or other
  modified_base (352)..(352): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaaacagtcggggcaggttataangtacactggtaccagcaacttccaggaacacgcccccaaactccctacaatccatgaactaccagaaactcggacccctcgggggtcccccngaccgattctctcggctccaaagtctagacacttcacgtcctccctgccatcactggctcagactgagatgaggctgactattactgccagtcctaatcgacagcaggctgactgcgttggttcgggtttcggcgggcggtaacgaagcgtcggaccgttctcgggttcaaccgg

SEQ ID NO: 375258 - DNA, 610 bp, Homo sapiens
  misc_feature: GZ8MTXP01CS1KW.51.82.H05.1.454.CMB.2.raw
  modified_base (182)..(182): a, c, t, g, unknown or other
  modified_base (207)..(207): a, c, t, g, unknown or other
  modified_base (230)..(230): a, c, t, g, unknown or other
  modified_base (289)..(289): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctnttcttggtggcagcaaccacaggancccactcccaggtgcagctggtncagtctgggactgaggtgaagagccgtgggcctcagtgaaggtctcctgcaagcttcgngactacaccttcaccgtactactatagtgctacgtggggtgccccgacgacgggccccctagggaaccgaaagggtcttggagtgggaagtggggatagggactacccgaaccctaagaagtggtacgaccaaactaaaccgttagtacgacctaacgtacgttaaccgtttttcgaacggggtcgttacggggtaccaacccgaagtacggaaccgacgaccgtaaccaactactacgtacgaccaaacaacaggttacaacgtagtggaagttcgacctaagcccgtgacccgtacgaccggtccgtttaagtttaagg

SEQ ID NO: 375259 - DNA, 698 bp, Homo sapiens
  misc_feature: GZ8MTXP01AHU5C.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagaggtcaccatctcctgcactgggaacagttccaacatcggggcaggttataatgtacactggtaccagcaacttccaggaacacgcccccaaactcctcatccatgataccagaaactccccggcccgtcgggggtccctcgaccgtaattcctcgtcgggcctaccgaacgtctacgactacctttccaacgtccccttccccgtcgggccctatacccgaccgttcggggcctacccgaacgaaccgttagggacgggtacggttagggaacggggtcctacggtaaccttaactttaaccgtcggtaccctacggttccccttaagttaccggaaccgtaacggtaccgaaacggggtccttaggtaaccgttcgggttccggtttcggggtttcgggggttttttcccgggggcccgggggtaacccgggggtaaccccgaaacggggttcccgttaacggggttaacccccggtttaaccccggg

SEQ ID NO: 375260 - DNA, 513 bp, Homo sapiens
  misc_feature: GZ8MTXP01DG3ZP.51.82.H05.1.454.CMB.2.raw
  modified_base (396)..(396): a, c, t, g, unknown or other
  modified_base (456)..(456): a, c, t, g, unknown or other
  modified_base (480)..(480): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagctgggctcagtgaaggtctcctgcaagacttctggatacaccttcaccgactactatatgcacgtgggtgccgacacggcccctggacgaaagggcttgagtggagtgggatggatcgacctaagaatggtgccaacaaactntagcacagtactttacgaggtcgtgggtcaccatgaccagcgaacactatctagcaaacncagtcttacgagtggagttgaccngccgtcgacccgcgacgggtccgttgttttaag

SEQ ID NO: 375261 - DNA, 643 bp, Homo sapiens
  misc_feature: GZ8MTXP01ACEXS.51.82.H05.1.454.CMB.2.raw
  modified_base (334)..(334): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggagccccactcccgaggtgcagctggtgcagtctgggactgaggtgaagagccgtgggcctgagtgaagtctcctgcaagcttcgtggactaccaccttacaccgtactactatagtgacacgtggggtcnccgaccgcggccccgtagggaacgaaacggggtcttggagtgggattggggatgggatacccgacctaaagaagtggtacgaccaacaaacttagacgaccaacgtacgttactttacggaacgggtccggttacggggtaccaacccgtagttaccggaacccgaggaccgaaaccaactacgttactaacggacccaaaacgaacttacggttacccttaacgtaacgtagggttacgttccgaacccgaacggttcccgtaacggacccggtaccgttaccgggttcccgtttggtttttaacggg

SEQ ID NO: 375262 - DNA, 671 bp, Homo sapiens
  misc_feature: GZ8MTXP01C2WZI.51.82.H05.1.454.CMB.2.raw
  modified_base (243)..(243): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagagggtcaccatctcctgcacgtgggaacagttaccaanagtcggggacaggttataatgtacactggtaccagcaactcaggaacacgacccccaaactcctacactccatacgaactaaccaagaaacgtccggcccgtccgggggtcccccctcggaccgtattcctcgtcggaccttccgaaagtctacgacctacttaccgacgcccctcccgtcggccctactccacgtcgggccctaccgagtaccgtaggaacggagtaggacggtcgttacgtaaccgtttaacttaaccgtcgtaccctacgttaccctaagtacgtaaccgacggacgaacgggtctacggttacgttcggttcgtttaacggtttcgggggttttacccggggcgggttacccggggtaacccgaacggtccgtcgggtaccccggttaccgtaaccggttaacccgaacccggg

SEQ ID NO: 375263 - DNA, 616 bp, Homo sapiens
  misc_feature: GZ8MTXP01CXGP6.51.82.H05.1.454.CMB.2.raw
  modified_base (181)..(181): a, c, t, g, unknown or other
  modified_base (206)..(206): a, c, t, g, unknown or other
  modified_base (296)..(296): a, c, t, g, unknown or other
  modified_base (573)..(573): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctnttcttggtggcagcaaccacaggancccactcccaggtgcagctggtgcagtctggggactggaggtagaagaagccgtggggcctcgagtgaaggtctcctgcaaggacttcgnggataccaccttcaccgtactactatatgacacgtggtcgcccgacgtacggccccgtaggaaccgaaagggtcttggagtgggagttagggattcggggatacccggaacccttaaaggaacgtcgggtacgacccaaacgaaaacttagcgacaacgtaacgtaccgttttacggaacgggtcgttacggggtaccaaccgagtacgaaccgagaccgtaacacacttacgacacaaaccaacgagttaccacgtaagtgggagttccggaaccncggtacctcgggaacccgacgacccgggtccgtttgttttaag

SEQ ID NO: 375264 - DNA, 610 bp, Homo sapiens
  misc_feature: GZ8MTXP01B3D3H.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtctcggggccccagggcagaggtccaccatctcctgcacgtgggaaacagttccaacgagtcggggcaggttaataatgtacactggtaccagacaactccaaggaacacgacccccaaactcctcactccatgaactaaccaagaaacgtccccggaccccgtcgggggtccctacgacccgtaacttctcgtcggcctaccaagtctacgacctacttccacgtcccctccgtcggacccactccgacgttcgggcctaccgacgacgtaggaggtacgtggacggtctacgtaccttattaccgtcgacctacgtcctagtcgacaacgcgacggtcttgtaccgtggttccgttgggttcggggtttccgggcgggaaccgggaccgtaggttccgtaacggaacccggttccg

SEQ ID NO: 375265 - DNA, 249 bp, Homo sapiens
  misc_feature: GZ8MTXP01DTW8I.51.82.H05.1.454.CMB.2.raw
  modified_base (247)..(249): a, c, t, g, unknown or other
tcagcgatcgtatacacgaccggtgctcgatttagtcgagctctctcgcgggcacgaccggtgctcgatttagtcgactctctcgcgggcacgaccggtgctcgatttagtcgagctctctcgcgggcacgaccggtgctcgatttagtcgagctctctcgcgggcacgaccggtgtcgatttagtcgagctctctcgcgggacatctgatcgtagcactctgagcgggctgggcaaggcgcatagnnn

SEQ ID NO: 375266 - DNA, 499 bp, Homo sapiens
  misc_feature: GZ8MTXP01CNJ7S.51.82.H05.1.454.CMB.2.raw
  modified_base (259)..(259): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacagtcggggcaggttataangtacactggtaccagcaacttcaggaacacgcccccaaactcctacatccatgataccagaaactcggcctcgggggtccccctgacgattctctcgctccaagtctgaccacttcacgccctccctgccactcacgtcgggctccagactgagatgagctagactatactgccagtcctaatgacagcagctgctgcgtgtggtttcggcggttcggaacagctgccgttctggcaacg

SEQ ID NO: 375267 - DNA, 540 bp, Homo sapiens
  misc_feature: GZ8MTXP01A9BRF.51.82.H05.1.454.CMB.2.raw
  modified_base (397)..(397): a, c, t, g, unknown or other
  modified_base (471)..(471): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagccgtggggcctcgagtgaaggtctcctgacaaggacttcgtggactacaccttcaccgtactactatatgcacgtgggtcgccgacacggccccgtaggacaaaggggcttggagtggatgggatggatcgaccctaagatggngaccaagaaacatgacaacgagtactttgagggcgtgggtacacgatcgaccagcaaccacatacacgcaaacnttacgttaccaactagtggagttcgaccaacgtccgaacgacccgagttaccggtccgttgttttaagg

SEQ ID NO: 375268 - DNA, 704 bp, Homo sapiens
  misc_feature: GZ8MTXP01DKIR0.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggaacagttccaaacatcggggcaggttataatgtacactggtaccagcaacttccaggaaacacgcccccaaactcctacatccatgaactaccagaaactccggcccgtccgggggtccccctcggaccgatttcctacgtcggactcccgaaagtcctacgacctacctttcacgtccccttcccgtcggaccctatcctaaccgtcggggacctacccgtaacgaccttaggaacgggaattacgggaaacggtccgttacgggtaacctttaaacgtttaccgttacggaccccttaacgggtttaccccttaagttacggtaaccgtaacggccgaaacggggtccgttacggttaaccgtttcggttaccgttttaaacgtttcgggggttttttacccgggccggggttaccggggtaacccgtaacggtccgtacggtacccgttccgttaacgggttcgaacccggg

SEQ ID NO: 375269 - DNA, 556 bp, Homo sapiens
  misc_feature: GZ8MTXP01EHDUF.51.82.H05.1.454.CMB.2.raw
  modified_base (261)..(261): a, c, t, g, unknown or other
  modified_base (286)..(286): a, c, t, g, unknown or other
  modified_base (326)..(326): a, c, t, g, unknown or other
  modified_base (409)..(409): a, c, t, g, unknown or other
  modified_base (517)..(517): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagctgggctnagtgaagtctcctgcaagacttcgnggactacaccttcaccgtactactatatgcacgtggggtncccgacgacggccccgtaggacgaaaaggggcttggagtggagtggggatggatcgaacctaagaatggtgaccaacaaactntcgacatacgtactttacgagggtcgttggggtaccaccagtacgaacccagtaccgaacactatacaacgacaaacacacgtaccttaagagtgggttattcgaccngccgtaacggacccgacgttaccggtccgtttgtttaag

SEQ ID NO: 375270 - DNA, 574 bp, Homo sapiens
  misc_feature: GZ8MTXP01CQ091.51.82.H05.1.454.CMB.2.raw
  modified_base (222)..(222): a, c, t, g, unknown or other
  modified_base (290)..(290): a, c, t, g, unknown or other
  modified_base (314)..(314): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacagggagcccactcccaggtncagctggtgcagtctgggactgaggtgaagagccgtggggcctgagtgaggtctctgacaagcttcgngatacaccttcaccgtactactanatgcacgtgggtcgcccgacacggcccctggacgaaaggggcttggaggtggagtggggatgggactccgaacctaagaagtggtacgaccaacaaactatcgacacgagtactttcgagggtcggttcgggtacaccgagtcgaccgagaccgacactacgttacaacgacaaacacgaagtaccactaagtgggttaacgttcggaaccctaacgcccgtaacggacccgacggttaccgggtaaccgttgttttaag

SEQ ID NO: 375271 - DNA, 512 bp, Homo sapiens
  misc_feature: GZ8MTXP01EVP1J.51.82.H05.1.454.CMB.2.raw
  modified_base (390)..(390): a, c, t, g, unknown or other
  modified_base (401)..(401): a, c, t, g, unknown or other
  modified_base (456)..(456): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactccccaggtgcagctggtgcagtctgggactgaggtgaagagcctggggcctcagtgaaggtctcctgcaagacttctggatacaccttcaccgactactatatgcactgggtgccgacacggcccctggaccaaagggcttgagtggatgggatgggatcgacctaagaatgtgcanaaactatgcanagtactttcgagggtcgtggggtcaccatcgaccagcgacacatactagcaaacncagtcttacagtggaagttcgactaagcctgacccgagaccggtccgttgtttaag

SEQ ID NO: 375272 - DNA, 538 bp, Homo sapiens
  misc_feature: GZ8MTXP01B4213.51.82.H05.1.454.CMB.2.raw
  modified_base (391)..(391): a, c, t, g, unknown or other
  modified_base (397)..(397): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgagagctgggcctcagtgaaggtctcctgcaagacttctggatacaccttcaccgactactatatgcacgtggggtgccgacacggcccctggacgaaagggcttggagtggagtgggatggatcgacctaagatggtgaccanaaactntgcacagtactttcgaggggtctggggttacaaccgagtcgaccacggcgaaccactagtacctagcaaacacacgtacttacgagtggttacgttcggaaccctggccctggacccgacgaccggtccgttgttttaacg

SEQ ID NO: 375273 - DNA, 705 bp, Homo sapiens
  misc_feature: GZ8MTXP01C0KQV.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtggggccccagggcagagggtccaccatctcctgcacgtagggaactagttccaaacagtcggggctaggttataatgtacacgtggtaccagcaaccttcaaggaaaccacgaccccccaaaactccctacactaccaattacgaactaacccgaagtaaacgtcccggcccggttccgggggtcccccctacggaccgtatttcccgtccgtcgggtacccttcccgaaaggttccctacggtacctacctttccgacgtccccttccccgtacggccctaacttccgaaccgttcggggaccttaccccgaaggtaccgtaggaacgggattagggaacggtcggttaacggtaactttaacttaccgtacgacccgtaacgtccttaacgtcgtaacacgtccgaggccttaggacgttggcgtttgggtttcgggttttccggggcgggttaccggggtaacccaacggccgttacggacccggttaccgtaacgggttccgtaacccgg

SEQ ID NO: 375274 - DNA, 630 bp, Homo sapiens
  misc_feature: GZ8MTXP01A0KWU.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagacggtcaccatctcctgcacgtggaacagttaccaacagtcggggcaggttataatgtacactggtaaccagcaacttccaggaacacgcccccaaactcctacatccatgataccagaaactccggcccgtcgggggtcccccctagacgtattcctacgtcggctccgaagtctcgacctacttcacgtcccctccctcgccactccacgtcgggaccttaccgagacgtgaggataggaacggtcgtacggtaaccttattaccgtacggtcctacggttacccttagttacgtaacccgtaggaccgacgggtcgtcgttactcggttccgttgggtttcgggttttccggggccgggttaccgggtaaccgaacggtccgttacggtacccgttaccggtaacggttccgtaaccccggg

SEQ ID NO: 375275 - DNA, 679 bp, Homo sapiens
  misc_feature: GZ8MTXP01CY2WU.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcggggcccccagggcaggaggtcaccatctcctgcacgtgggaacagttccaaacagtcggggactaggttataatgtacactggtaccagcaacttcaaggaaaccacgacccccaaactccctacaactccgatcgaactaaccgagtaaacgtcccggcccgttccggggggtccccccctacggaccgtatttccctcgtacggcctaaccgtaaagtcctacgaacctacttccacgtcccctcccgtcggaccctacgtccgaccgttcgggaccttaccgacggaccgtaggaggagttacgggaacgggtcgtaacggtaacctttaacttaaccgtcgtacctacgttacctaagtcgaacgacggccgtaaggtctacgttaccgttggttccgtttggggtttcgggtttaccgggggcgggttaaccgggtaacgacggtcgttacggacccggttccgttaacggccgaacccgg

SEQ ID NO: 375276 - DNA, 544 bp, Homo sapiens
  misc_feature: GZ8MTXP01C50JQ.51.82.H05.1.454.CMB.2.raw
  modified_base (352)..(352): a, c, t, g, unknown or other
  modified_base (468)..(468): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggaacagttccaaacagtcggggcaggttataatgtacactggtaccagcaacttcaggaacacgacccccaaactcctcatccatcgataccagaactcggcccgtcgggggtccccctgacgnttctctcgctccaagtctagacacttcacgccctccctcgccatcacgtcggctccagacgtgagatagaggcgtacgacgttaattacgtcgccctagtacctatcgactagcgnggtctgactgcgttggttcggttttcgggcggcgggtaaccaggtcgtcggaccgttccgtaacggttcgaaccgg

SEQ ID NO: 375277 - DNA, 545 bp, Homo sapiens
  misc_feature: GZ8MTXP01DQ29P.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcactgggaacagttccaaacagtcggggctaggttataatgtacactggtaccagcaactcaggaacagcccccaatcctacatccatcgataccagaaactccggcccgtcgggggtccccctggaccgtattcctctcggctccaagtctagacctacttcacgtccctccctgcctatcacgtcggcctccagtactgagatgacggcttagacttaattacgtgcctagtccctatcgacagcaggctagctgttgttggttggtttcgggcgggttccgggaacaggtctacggaccgttcgtaacggttcgaaccgg

SEQ ID NO: 375278 - DNA, 724 bp, Homo sapiens
  misc_feature: GZ8MTXP01EITPY.51.82.H05.1.454.CMB.2.raw
  modified_base (591)..(591): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgcccgccctcagtgtcgtcggggccccagggcagaggtcacatctctgcacgtgggaacagttaccaacagtcggggactaggttaataatcgtacactcggtaaccagacaaccttaccgaaggaaccaccgaccccccaaactccctacactccatacgaactaaccgaagtaaaccgtcccggggtaccccggtccgggggttaccccccctacgggtaaccgtactttcccgtacgttcgggtacccttcgttaaacgtcctacgtacctacctttacgaccgtcccctcccgtcgaccactccgacgtcgggtacctaccgagtaccgtaggacgggagtaggacggtcgttacggtaacgttacttaccgtacgtacccgtaacgttactaacgtacgtacgacgtaccgngggtaaccttaggttacgttcggttcggtttcggggtttcggggttttccgggggccggggttacccggggtaaccgtaaccgtccggtaccggtacccggttaccggttaacgggttaacccgtaacccggg

SEQ ID NO: 375279 - DNA, 589 bp, Homo sapiens
  misc_feature: GZ8MTXP01DWM2R.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtggggccccagggcagaggtcaccatctcctgcacgtgggaacagttccaaacagtcggggcaggttataatgtacactggtaaccagcaactcaggaaacacgacccccaaatccctacatccatgaataccagaaactccggcccgtccgggggtccccctcggaccgtattcctcgtcggccttccgaagtcctagacctacttcacgtccctcccgtggacctatccacgtcgggaccttacccgaagtaccgtaggaaggattaggacgggtctacgtacttaacttaccgtcgccctagttcctaaatcgtaacagcgaggtctgactgttcgttggttcggtttcgggcggttacggaaccagctcggaccgttcgtaacggttcgaaccgg

SEQ ID NO: 375280 - DNA, 753 bp, Homo sapiens
  misc_feature: GZ8MTXP01ELRQM.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgccgccctcagtgtcgtggggccccagggcagagggtcaccatctcctgcacgtgggaacagttaccaaacagtcggggctaggttaataatgtacactggtaccagacaactaccgaaggaaacaccgacccccaaactcctacactccaatacgaaactaaccgaaagtaaaacgttcccggggacccccgttaccggggggtacccccccttacgggaaccgtactttcccgttccgtaaccgggtcccttaacccgtaaacggttccttacgaaccctaccgtttaccgaacgtcccctccccgtcggtaccctaactcccgtaccggttcgggaccttaccgaacgtaccgtaggacggtagtagggacggtacgttacggtaaaccttaagttaccgtcgtcccgtaacgttcccttaagtcgtaaaccgacgaccgaaggggtcttacggttaaccgttcggttccgttgggggttttcggggttttccggggaccgggggttacccggggtaacccgaacggtcccggttacggtacccggttacccgttaacgggttaaccgaacccggg

SEQ ID NO: 375281 - DNA, 662 bp, Homo sapiens
  misc_feature: GZ8MTXP01BK4QD.51.82.H05.1.454.CMB.2.raw
  modified_base (624)..(624): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactccccaggtgcagctggtgcagtctgggactgaggtgaagagcgtggggcctcagtgaagtctcctgcaagacttctggatacaccttcaccgactactatatgcacgtgggtcgccgaccgacggcccccgtaggaccgaaaagggtcttgggagtagggagtcggggagttaggggactaccggaacccgttaaaggaagttacgggtacggtacccgaaaccgtaaaaccgttaacttacggacgtaaccgtaacgttacgttttaccggtacggggtacggggttcggggttaccgaaccgtacgttacggaaccgacggacggaaccaacctactaccgtaacgacaaacctaacgacgttaccgttacgtaacgtagggttaacgttcgttaaccaacggtaccncggtaacccgacgttaccgggtcgttaacgttttaagg

SEQ ID NO: 375282 - DNA, 581 bp, Homo sapiens
  misc_feature: GZ8MTXP01EBMKP.51.82.H05.1.454.CMB.2.raw
  modified_base (334)..(334): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctggggactgaggtgaagagcctggggcctgagtgaaggtctcctgacaagacttcgtggactaccaccttcaaccgtactactatatgcacgtgggtcncccgacgacggccccgtaggaacgaaaggggtcttggagtgggagtgggatgggatcgacctaagatggtagacaacaaactatgacacgacgtactttacgagggtcggtcgggtacaaccagtacgaaccgagacgaacactatacgtacgacaaacacacgtacttaaacgagtagggttacgttcgaccgaacggtcccgtaacggaacccgaccggaccgggtcccgtttaaggttttaagg

SEQ ID NO: 375283 - DNA, 555 bp, Homo sapiens
  misc_feature: GZ8MTXP01A9460.51.82.H05.1.454.CMB.2.raw
  modified_base (413)..(413): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactgaggtgaagagcgtggggcctgagtgaaggtctctgcaagcttcgtggatactaccttcaccgtactactatatgctacgtgggtcgccgacgacggccccgtaggacgaaagggcttggagtgggagtgggagtggactccgacctaagagtggtcgaccaacaaactntagacacgtagtactttcgagggtcgtcgggtacacgtagtacgaccgagaccgacactactcgtaacgacaaacacttagtacttacgagtcgggttagttcgacctcgaccgtcgaccgacgaccggtcgttgttttaag

SEQ ID NO: 375284 - DNA, 597 bp, Homo sapiens
  misc_feature: GZ8MTXP01CTCYN.51.82.H05.1.454.CMB.2.raw
  modified_base (262)..(262): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagcgtgggctnagtgaaggtctctgcaagtcttcgagactacaccttcaccgactactatatgctagtgggtcgcccgacgacggcccgtaggaacgaaagggtcttggagtagggagtggggatgggactaccgaaccctaagaagtcggtacgaccctaaacaaactagtacgactaacgtacgttactttacggaacgggtcgtacggggtaccaacgacgtaccgaaccgaggccaaacctactacttcgaaacgaccaaacacgacgttacaacgtagtaggttacgttacgacctaacgcccgtaacgacccggtaccgacgggttccgttgttttaagg

SEQ ID NO: 375285 - DNA, 775 bp, Homo sapiens
  misc_feature: GZ8MTXP01BYDOM.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgcccgccctcagtgtcgtcggggccccagggcaggagggtcaccatcctcctgcacgtgggaacagttaccaacaggtcgggactaaggttataagtgtaacacgtcggtaaccagacctaacttccgaaggaaacccaccgaccccccaaactccctacaactcccatacgaactaaccgaagtaaacgtcccggggaccccggttccgggggtacccccctacggaccggtactttcccgtcgtacgggtacccttaacccgtaaacgttcctacgaacccttaccgtttccgaacccgttcccccttccccgtacgggtacccctaacgtcccgtaaccgttcggggtaccccttaccgaacggtaccgttaggaacggtacgtacggtaacgggtccttaacggtaactttacgttaacctcggtcccgtacgttacccgttagtcgaaaccgtacgacgtacgggtctcggttaccgttcggttcgtttgggtttccggggttttcccggggccggggttacccgggaaccggttaaccggtccggttaacccgggtaccccggttaccggttaaccgggttcccgtaaccccggg

SEQ ID NO: 375286 - DNA, 568 bp, Homo sapiens
  misc_feature: GZ8MTXP01ER63F.51.82.H05.1.454.CMB.2.raw
  modified_base (290)..(290): a, c, t, g, unknown or other
  modified_base (329)..(329): a, c, t, g, unknown or other
  modified_base (473)..(473): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactccccaggtgcagctggtgcagtctgggactgaggtgaagagccgtgggcctcagtgaaggtctcctgcaagacttcnggatacaccttcaccgtactactatatgcacgtgggtcnccgacacggcccctaggacaaagggcttggagtggagtgggatggataccgacctaagaagtggtcgaccaactaaactatgacacagtactttagagggtcgtggggtaccaactactacgaaccagacgaaccactatacanacaaacaacttagtccttaacgagttagggttacgttcgaaccgaacgtcccgtaacggaacccggtaccgaaccgggtccgttaagttttaagg

SEQ ID NO: 375287 - DNA, 542 bp, Homo sapiens
  misc_feature: GZ8MTXP01D7LW9.51.82.H05.1.454.CMB.2.raw
  modified_base (385)..(385): a, c, t, g, unknown or other
  modified_base (457)..(457): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagctgggctcgagtgaaggtctctgcaagtacttcgtggatacaccttcaccgactactatatgcagtggtgcgacaggcccctaggacaaagggcttggagtggatgggatggactcgacctagaatcggganaccaacgaaactatgacaactagtactttacgacgggtcgtacgggtacaaccagtcgaaccagacgaaacnctaagtcctaagcaaactacagtaccttagagtcggttagttcaccgaacgcctaagacccacgaccggtccgttaagttttaag

SEQ ID NO: 375288 - DNA, 715 bp, Homo sapiens
  misc_feature: GZ8MTXP01EH86M.51.82.H05.1.454.CMB.2.raw
  modified_base (188)..(188): a, c, t, g, unknown or other
  modified_base (240)..(240): a, c, t, g, unknown or other
  modified_base (248)..(248): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctnagtcgtcgtcggggccccagggcaggaggtcaccatctctgcacgtggaacngttccaangtcgggacaggttataatgtacactggtaccagcctaaactccaaggaaccacgacccccaaactcctacactcccatcgaactaccaagtaaacgtccccgggaccccgttcgggggtaccctaggacccgtaatttcccgtcgtcgggacccttacccgaaacgtctacggaaccttaacccgtttcccgaaccggtaccccttcccccgtacgggtacccctaacggttacccgtaaccggtttcgggggacccttaccccggaaaggtaacccgttaggggaaaccggttaaggttcggaaacggggtccttaacggtaaacttaacttaacgtcggaccctacggttccctaagtacgaccgaaggacacgggtcttacgtaccgtgcggtttcgggttacggggtttccgggacgggtaaccgggaacctacggcctaaccgggttaacccggttaaccgg

SEQ ID NO: 375289 - DNA, 577 bp, Homo sapiens
  misc_feature: GZ8MTXP01EBKB2.51.82.H05.1.454.CMB.2.raw
  modified_base (331)..(331): a, c, t, g, unknown or other
  modified_base (507)..(507): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactggaggtgaagagccgtgggcctgagtgaagtctctgcaagcttcgtgactaccaccttcaccgtactactatatgactacgtgggtcncccgacgacggccccgtgggaaccgaaagggtcttggagtgggagtggggatgggactaccgaacctaagaacgttggacgacccaaataaacctagtcgactacgagttactttacgaacggggtcggtacgggtacaccagtacgaccgagcgaacactactacgacacaaacncagtacttaagaggtggttacgttcgaccgcgaccgtaacggaccgacgttacgggttcgtttaagtttg

SEQ ID NO: 375290 - DNA, 702 bp, Homo sapiens
  misc_feature: GZ8MTXP01D4DVI.51.82.H05.1.454.CMB.2.raw
  modified_base (181)..(181): a, c, t, g, unknown or other
  modified_base (201)..(201): a, c, t, g, unknown or other
  modified_base (220)..(220): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctnttcttggtggcagcaaccanaggagcccactcccaggtncagctggtgcagtctgggactggaggtgaagagccgtggggcctgagtgaaggtctccgtgacaagacttcgaggactacaccttacaccgtactactaatagtgcctacgtggggtcacccgacgacggccccgtaggaccgaaaagggtcttggaggtgggagttgggaagttcggggaacttacccggaaacccttaaaggaaacgttcggggtacgaacccaaacgtaaaaccttagtacggacctaaacgtaacgttaacttttacggaagggtccggttacggggttaccaacccgtaagtaccgaacccgaaggaccgaaacctaacgacttaacctaacggaaccctaaaacaacgttaacggttaacccgttaaacgtaaggtaacgggttaacgttaccgaacccgtaaccggtacccgtaaccggaacccggtaccggttaccgggttaaccggttttaaggttttaacgg

SEQ ID NO: 375291 - DNA, 642 bp, Homo sapiens
  misc_feature: GZ8MTXP01BC093.51.82.H05.1.454.CMB.2.raw
  modified_base (188)..(188): a, c, t, g, unknown or other
  modified_base (255)..(255): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctnagtcgtcgtcggggccccagggcaggaggtccaccatctctgcacgtagggaactacgttaccaacnggtcgggacaggttatatcgtacacgtggtaccagactaactccgaacggaaccaccgacccccaaactcctacactccatagaactaacaagaacgtccccggacccggtcgggggtcctcgacccgtaacttcctcgtcggtaccctaccgaacgttccgtacgaacctaccttcaccgtccctccgtcggacctaacgttccgacggttcgggccctaccgaacgtacgtaggacggtagtagggtacggtctacgtaacttacttacgcggtacctacgtcctaagtcgaacgaacgcgaggtcttcggtactcggttcgttcggtttcggggttcgggcgggtaaccggtacgacggttccgtaacggttcccgttaaccgg

SEQ ID NO: 375292 - DNA, 539 bp, Homo sapiens
  misc_feature: GZ8MTXP01AXN81.51.82.H05.1.454.CMB.2.raw
  modified_base (286)..(286): a, c, t, g, unknown or other
  modified_base (385)..(385): a, c, t, g, unknown or other
  modified_base (392)..(392): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagctggggcctgagtgaagtctcctgcaagcttcnggatacaccttcaccgactactatatgcacgtgggtgccccgagacggcccctggacgaaagggcttggagtggatgggatgatcgacctaagactggngaccaanaaacctatcgcaacgagtactttacgagggcgtggggtcaccgatcgacccagccgaacactactcaagcaaacacagttcaacgagttaggacggttcaccgtaagccctaaggacccgacgttaaccggccgttaagttttaagg

SEQ ID NO: 375293 - DNA, 596 bp, Homo sapiens
  misc_feature: GZ8MTXP01D0AEJ.51.82.H05.1.454.CMB.2.raw
  modified_base (247)..(247): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtcgtggggccccagggcagaggtcaccatctcctgcactgggaacagtaccaacngtcggggacaggttataatgtacactggtaccagctaactccagaacacgacccccaaatcctacactccatgaactaccagaaactcccggcccgtcggggtccctgaccgtattctcgtgcctaccaagtctacgacctacttcacgccctccgtcgccacgtaccacgtcgggacctccgacgacgtaggaacggtagtacgggaggtactacgttaactacttacgtcgtacctacgttcctacgtcgaacgaacgcgaggtcgttgtaccgtgttcggtttggttcgggttttccgggccgggtccgggtaaccgacggttccgtcggttaacccggtaacccg

SEQ ID NO: 375294 - DNA, 505 bp, Homo sapiens
  misc_feature: GZ8MTXP01BOEV3.51.82.H05.1.454.CMB.2.raw
  modified_base (206)..(206): a, c, t, g, unknown or other
  modified_base (220)..(220): a, c, t, g, unknown or other
  modified_base (260)..(260): a, c, t, g, unknown or other
  modified_base (281)..(281): a, c, t, g, unknown or other
  modified_base (317)..(317): a, c, t, g, unknown or other
  modified_base (323)..(323): a, c, t, g, unknown or other
  modified_base (449)..(449): a, c, t, g, unknown or other
  modified_base (474)..(474): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtgcagcaaccacaggancccactcccaggtncagctggtgcagtctgggactgaggtgaagagctgggctnagtgaggtctctgcagcttcnggatacaccttcaccgactactatatgcacgtggtnccgacnggcccctggacaagggctgagtggatgggatggatacgacctaagatggtacgacacaaacgtatgacacagtactttcgagggtcgtagggtcaccgatacgaccaggcactacatcagccaaancagtccttagtatggacgttcaccngcctcggaccgacttacggtcgttgtttaag

SEQ ID NO: 375295 - DNA, 597 bp, Homo sapiens
  misc_feature: GZ8MTXP01C0RBJ.51.82.H05.1.454.CMB.2.raw
  modified_base (252)..(252): a, c, t, g, unknown or other
  modified_base (461)..(461): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcgagtcgtccgtcggggcccccagggcaggagggtccaccatctcctgcacgtagggaacagttaccaanagtcggggcaggttataatgtacactggtaccagacaacttcaggaaaccacgacccccaaactccctacactcccatagaactaccgaagaaacgtccggcccgtccgggggtcccccctacggaccgtattcctcgtcggacctccaaagtctacgactactcacgccctcctgccatcactggctccagacgtgacgagtgacggntacgtacttattacgtcgccgacgttcctagtacgtacgacgcgagggtctcggactggcgttcgggttggggttttccgggcgggttacgggaaccgacgtccgtcggtacccgttcgtaacggttcgaacccgg

SEQ ID NO: 375296 - DNA, 549 bp, Homo sapiens
  misc_feature: GZ8MTXP01DD6I4.51.82.H05.1.454.CMB.2.raw
  modified_base (182)..(182): a, c, t, g, unknown or other
  modified_base (313)..(313): a, c, t, g, unknown or other
  modified_base (390)..(390): a, c, t, g, unknown or other
  modified_base (395)..(395): a, c, t, g, unknown or other
  modified_base (399)..(399): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctnttcttggtggcagcaaccacaggagcccactcccaggtgcagctggtgcagtctgggactgaggtgaagagcgtgggcctgagtgaaggtctcctgcaagacttctggataccaccttcaccgactactanatgcacgtggtcgccgacgacggcccctaggacgaaagggcttggagtggagtgggatggatcgacctaagagtggnacaanaatntgacactagtactttacgagggtcgtaggtacaccgtagtacgaccagcgaacactatacagaccaacacgttagtacacgtagtcggttaacgttaaccgacgtccgtacgaaccgaccgtacggttccgttaagtttaagtttttggg

SEQ ID NO: 375297 - DNA, 587 bp, Homo sapiens
  misc_feature: GZ8MTXP01EZDPL.51.82.H05.1.454.CMB.2.raw
  modified_base (186)..(186): a, c, t, g, unknown or other
  modified_base (244)..(244): a, c, t, g, unknown or other
  modified_base (313)..(313): a, c, t, g, unknown or other
  modified_base (380)..(380): a, c, t, g, unknown or other
  modified_base (412)..(412): a, c, t, g, unknown or other
  modified_base (442)..(442): a, c, t, g, unknown or other
  modified_base (488)..(488): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgcctnagtgtcgtcgggcccagggcagaggtcacatctctgcacgtggaaactgttaccaagngtcgggactaggttaatatgtaacactggtaccagacaacttccgaagaacacgacccccaaatcctanactccgatacgaataaccaacgaaacgtcccccggacccgtcgggggtaccctacgacgtaacttcncgtcgctcaagtctacgactctcacgtcctcncgtcatcacgtcggactccgagacgagagngtacgaggtctagtactacgtacgtcaccgtctacctaagtacganaacgcgttacgtcgttacgtacgttcgttcggttgggttaccgggttcgggacgggtaaccggaccgtacggttaccgttaaccggttaaccgtaacgg

SEQ ID NO: 375298 - DNA, 600 bp, Homo sapiens
  misc_feature: GZ8MTXP01B4AL0.51.82.H05.1.454.CMB.2.raw
  modified_base (231)..(231): a, c, t, g, unknown or other
  modified_base (331)..(331): a, c, t, g, unknown or other
tcagcgatcgtatacacgaccggtgctcgatttagtcgagctctctcgcggtcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtncagtctgggactggaggtgaagagccgtgggcctcgagtgaaggtctcctgacaagacttcgtgatacaccttcaccgtactactatatgcacgtgggtncccgacacggccccgtggacaagggtcttggagtgggagtgggatgggactaccgaacccgtaagaagtcgggtacgaccgaactaaactacgtcgacaacgtacgttactttacgacggggtcgttacggggtacaccgaacgtacgaaccaggaccgaacactactactaacgcaaaccacgttagtaccttacgtagtgggttacgttcgaacccgtgaccccgtcggaaccccggacgttacccggggtccgtttggttttaacg

SEQ ID NO: 375299 - DNA, 593 bp, Homo sapiens
  misc_feature: GZ8MTXP01EZOYJ.51.82.H05.1.454.CMB.2.raw
  modified_base (266)..(266): a, c, t, g, unknown or other
  modified_base (436)..(436): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagccaaccacaggacgcccactccccaggtgcagctggtgcagtctgggactgaggtgaagagcgtgggcctnagtgaaggtctcctgcaagtcttcgtggataccaccttacaccgtactactatactgcacgtgggtcgccgacgacggccccgtaggaaccgaaaggggtcttggaggtgggtagtaggggattggggactaccgaacccgtaagaagtgggtacacccaaataaaactntagactaagacgttacgtttagacgggtcggtcgggtaccacgatacgaccaggaccaacactagttacacgaacaacgaacttacgtacttacgaagtggttacggttcaaccgaacgccgtaacggaccgacgttacggtccgtttaagtttaag

SEQ ID NO: 375300 - DNA, 669 bp, Homo sapiens
  misc_feature: GZ8MTXP01CQRE5.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtcgtgggactggaggtgaagagccgtgggcctgagtgaaggtctctgacaagtcttcgtaggactaccacccttcaccgtactactatacgtgactacgtgggtcgacccgacgacggtccctacgtacgggaaaccgtaaagggggtcctttagggagggttaggggtagttggggaacgttggggaactaccggtaaaccctaaaggtaacgttgggtacgaacccgtaaactaaacgttagtacgaccaacgtaacgttacgttttaccggaaggggggtccgttacggggtaccctaaaccgtagtaccggaacccgacggaccgaaacctactaacttaccgaacgaaccaaacacgtacgttctaaacgtggttaggttacgttacgaaccgacggcctacggacccgacgtaaccggttcgtttaagg

SEQ ID NO: 375301 - DNA, 533 bp, Homo sapiens
  misc_feature: GZ8MTXP01DXR4E.51.82.H05.1.454.CMB.2.raw
  modified_base (98)..(98): a, c, t, g, unknown or other
  modified_base (125)..(125): a, c, t, g, unknown or other
  modified_base (207)..(207): a, c, t, g, unknown or other
tcagcgatcgtatacacgaccggtgctcgatttagtcgagctctctcgcgggcacgaccggtgctcgatttagtcgagctctcagagagaaagggggncatcacccagcaaccacatctgtcctntagagaatcccctgagagctccgttcctcaccatggactggacctggaggatcctcttcttggtggcagcaaaccacaggancccactccaggtgcagctggtgcagtctgggactgaggtgaagaagctgggctcagtgaaggtctcctgcaagacttctgatacaccttcaccgactactatatgcacgtggtgccgacaggcccctggacgaaagggcttggagtggagtagggatggatcgacctaagaagtggtgacaacaaaactatagacactaagtacttttacgacggggtcgtcggggtaccaaccatacggacccagccgaaacactatctaacgcaaacacatacttacagtggacgttgaaccaagcctggaccgacacggtccgttgttttaag

SEQ ID NO: 375302 - DNA, 752 bp, Homo sapiens
  misc_feature: GZ8MTXP01C7MPO.51.82.H05.1.454.CMB.2.raw
  modified_base (187)..(187): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctnagtgtcgtcggggccccagggcaggaggtcaccatctctgcactgggaacagttccaacagtcggggcaggttataagtcgtacacgtgtaccagcaactccagaacacgacccccaaactcctacactaccatagactaccaacgtaaaccgtcccggccccgtacgggggtccctacggacccgtaacttcctccgtcggtaccctaccgtaaccgttccgtacgaccgtaccttaccgtaccgtccccgttccccgtcggtaccctaccgtaccgtaccggtccgggtacccgttaccgaacgtaccggttaacgggacgggttaacggggtaacggtacggggttacccgttaacggttaaaccctttaaccgtttaccgtacccgtaacccgttaccggttacccttaacggtaccggtaacgaaccggtacggacggtaccgttacgtaacccggttcggttccggtttcggggttttaccggggtttcccgggggaccgggtaacccggggtaacccgtaacgggttccgtaaccgggttccccggtttaaccccggg

SEQ ID NO: 375303 - DNA, 753 bp, Homo sapiens
  misc_feature: GZ8MTXP01CGLMH.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacgagggtcctgggcccagtctgtactgacgcagccgccctcagtgtccgtcggggccccagggcaggacgggtcaccatcctcctgcacgtgggaactagttaccaacgagtccggggactaaggttaataatcggtaacacgtacggtaacccagacctaaaccttaccgaacggaaacccacccgacccccctaaactccctacactacccatacgaactaaccaagtaaaccgtcccgggtaccccgttccgggggtacccccctaggaccgtactttcctcgtacggtccctaaccgaaacggttcctacgtaccctaccttaccgaccgtccccttaccccgtcggtacccaacgttccgaaccgttcggggaccctaccgaacgtaccgtaggaacggtagtacgggacggtactacggttaacttaacgtttacgccggtaaccctacgtccttaacgtaccgacgacgtaccgacgggtctaacggttccgttggttccgtttcggggttttcgggtttccggggccgggttacccggggtaaccaacgggtccgttaacccgggtacccggttaccggttaacggttcccggtaaaccccgg

SEQ ID NO: 375304 - DNA, 680 bp, Homo sapiens
  misc_feature: GZ8MTXP01EU8Z1.51.82.H05.1.454.CMB.2.raw
  modified_base (295)..(295): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagccaaccacaggacgcccactccccaggtgcagcgtggtgcagtcgtgggactggaggtgaagagcgtgggctgagtgaagtctcctgacaagtacttcgngactacctacctcgacctactactatagtgacacgtgggtcgacccgacgacggcccgtagaacgaaagggtcgttggaggtgggacgtggggtaatgggaactacccggaaccctaaagaacgtggtacgaccaaactaaaactgtacaacctaacgtaacgttaacgtttacgaacgggtcggtaaccggggtacctaaaccgagttaaccgaacccgtacggaaccggaaccaccgtaattaccctaaacggaccaaaactcccggttaagtaaccttaacgtaaggttacggggttaaacggttccaaacccgggaacgttccgtaacccgggtaaacgggaccgttaccggggtttaacccggttttaagtttttaaggg

SEQ ID NO: 375305 - DNA, 503 bp, Homo sapiens
  misc_feature: GZ8MTXP01BUQEX.51.82.H05.1.454.CMB.2.raw
  modified_base (399)..(399): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaacatcggggcaggttataatgtacactggtaccagcaacttccaggaacacgacccccaaactcctacatccatgataccagaaactcccggccccgtacgggggtccctgacccgaacttctctggcctccaaacgtctgacacttcacgcctccngccatcactggctcagactgagatgaggctgactattactgcagtcctatgcaagcaggcttgactgcgttgttggtttcggcgcgggccaggctgaacgtccg

SEQ ID NO: 375306 - DNA, 649 bp, Homo sapiens
  misc_feature: GZ8MTXP01EUYW8.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggacgcccactccccaggtgcagctggtgcagtctgggactggaggtagaagagccgtggggcctcgagtgaaggtctcctgacaagtacttcgtaggactacaccttacaccgtactactatatgcacgtgggcaccgacgacggcccctaggacgaaagggtcttggaggtgggagtgggattgggattaccgaacctaagaagttgggtacgaccaaacgtaaaactagtacgacaacgtacgttaaccgttttacggaacggggtccggttacggggtaccctaaccgaagttaccgaaccccgaagggccgaaaccaactacgttacctaaacggacctaaaacgacttaaggtacccttaaagacgttagggttacgttacggaaccgtaacgacccgtaacggaacccgtacggttaccggttccgtttaaggttttaag

SEQ ID NO: 375307 - DNA, 586 bp, Homo sapiens
  misc_feature: GZ8MTXP01ENA5M.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtcggggccccagggcagaggtcaccatctcctgcacgtgggaacagttccaacagtcggggcaggttataatgtacactggtaccagcaacttccaaggaacacgacccccaaactcctcactccatgactaaccagaaactcccggcccgtcgggggtccctgacccgaattctcgtcggctaccaagtctgactacttcacgtccctccgtcggccattccacgttcgggcctaccgacgtacgtaggacggaggtggaacggtcgtagacttaacgttacgtcgaccgtacgttcctagtcgacgaagcgaggtcttcgacgttgttcgttcggttcgggtttcgggacgggtccggaccgacggccgtaaccgttccggttaacccgg

SEQ ID NO: 375308 - DNA, 537 bp, Homo sapiens
  misc_feature: GZ8MTXP01BEIYC.51.82.H05.1.454.CMB.2.raw
  modified_base (180)..(180): a, c, t, g, unknown or other
  modified_base (204)..(204): a, c, t, g, unknown or other
  modified_base (218)..(218): a, c, t, g, unknown or other
  modified_base (283)..(283): a, c, t, g, unknown or other
  modified_base (396)..(396): a, c, t, g, unknown or other
  modified_base (403)..(403): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggagatcctnttctggtggcagcaaccacaggancccactcccaggtncagctggtgcagtctgggactgagtgagagctgggctcagtgaaggtctcctgacaagacttcgnggatacaccttcaccgactactatatgcacgtgggtcgccgacgacggcccctggacgaaaagggtcttggagtgggatggggatgggactcgaaccctaagaacgtgggtanaccgaanaaactatgacacagtactttcgaggcgtgggtcacatgaccagcgacacatctagcaaacacgagtcaacgtagtaggttagttcgaccgtaagtcccgaacggacccgagttacccgggtccgttgttttaag

SEQ ID NO: 375309 - DNA, 614 bp, Homo sapiens
  misc_feature: GZ8MTXP01BXVDN.51.82.H05.1.454.CMB.2.raw
  modified_base (223)..(223): a, c, t, g, unknown or other
  modified_base (315)..(315): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaactcccctgagagctccgttcctcaccatggactggacctggagatcctcttcttggtggcagcaaccacaggacgcccactcccgaggtncagctggtgcagtcgtgggactgaggtgaagagcgtgggcctgagtgagtctctgacaagtcttgagataccaccttcaccgtactactatntgcacgtgggtcgacccgacgacggccctagggacgaaacgggtcttggagtgggagtggggatcgggactccgaaccgtaaagacgtcggtacgaccaactaaaactgtacgacacgtacgtacgtttcgacgggtcggtcgggtaccacgacgtacgaacccaggacaaccactactacgtaacgacctaaaccaagttaacggtacaaacgtaggttacgggttacgttcgaacccgtaacggcccgttaacgggaaccccggtacggttaccggggtaacgttttggtttttaag

SEQ ID NO: 375310 - DNA, 649 bp, Homo sapiens
  misc_feature: GZ8MTXP01BPOCT.51.82.H05.1.454.CMB.2.raw
  modified_base (306)..(306): a, c, t, g, unknown or other
  modified_base (480)..(480): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgccgccctcagtgtcgtggggccccagggcagaggtcacatctcctgcacgtggaacagttaccaacagtcggggactaggttataatgtacacgtgtaccagcaactccaggaacacgaccccaaactccncactccatacgaactaaccgagtaaacgtccgggccccgtccgggggtaccccccctaggaccgtattccgtacgtcggaccttccaaagttcctacgacctaccgttcaccgtccccgtcccgtcggacctacgtccgaccgtcgggtacctaccgaacgacgtaggaggtanagtacggctaggtaacctttacttaccgtcgtaccctacgttaccctaagtcgaaccgtacggcgtaacgggtcctgttacgttcggttcgtttggggttcggggttttcgggcgggaccgggtaaccaacgtccgtaccggtaccgttccgttaacggccgaacccgg

SEQ ID NO: 375311 - DNA, 683 bp, Homo sapiens
  misc_feature: GZ8MTXP01CQ0IO.51.82.H05.1.454.CMB.2.raw
  modified_base (377)..(377): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcggggccccagggcagaggtcaccatctctgcacgtgggaacagttccaacgagtcggggctaggttataagtgtacacgtcggtaaccagtaccaaccttccaaggaaccaccgaccccccaaactcctacactccatgaactaccagaaacgtccggcccgtcgggggtcccccctggaccgtnttccgcgtcggcctccgaaagtcctagacctaccgttaccacgtcccctcccgtcgacctactccgacgtcgggacctaccgacggtacgtaggaggtacgtagggacgtcgtacggtaacttacgttaccgtcggtaccctacggttaccctagtacgtaacgacgtcgtacggtctcgttacgttcggttcgtttcggggttccggggttttcccggggccggggttacccgggtaaacccggtaacggtcccggttaccgggtaccccggttacccggttaacgggttccccgtaaccccggg

SEQ ID NO: 375312 - DNA, 656 bp, Homo sapiens
  misc_feature: GZ8MTXP01AS302.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcggggccccagggcagaggtcaccatctcctgcacgtgggaacagttccaacgagtcgggacaggttataatgtacacgtggtaccagacaacttccaaggaaccacgacccccaaactccctacactccatacgaactaccaagaacgtccccggccccgtcgggggtccctcgaccgtaacttccgtcgtcgcctaccgtaagtcctacgacctaccttcgaccgtcccctacccgtcggacccctagttaccgacggttcgggaccctacccgaacgtacgttacgggaacggacgggttcgggaacggtccttacggtaaccttaacgttcgtaccgtacccgtacgttaccctaagtccgaacgaacgcgaggtcttgtacgtggttcgttcgggtttcggggtttcgggccgggtaaccgggaacacgggttccgtaacgttaacccggttccg

SEQ ID NO: 375313 - DNA, 632 bp, Homo sapiens
  misc_feature: GZ8MTXP01D1I4B.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtcgtgggactggaggtagaagagcgtgggctcgagtgaacgtctctgacaagtacttctaggactacctaccttcaccgtactaactatactgactacgtgggtcgccgaccgcggccccgtaggaccgaaagggtcttggaggtgggagtgggagtcggacgtaccgaccgtaagaagtggtcgaccaaacgaaactagtacgaccaatacgttacgtttcggacggtcggttacgggtaccacgtacgacggacccagggaccaaacactacgttacgacgaaccaaactacgttagttaccttaacgtaggtacgggttacgttaccgaacccgtaacggtaacccgtccggaacccggtacgttacccggggttccgtttaaggtttttaacgg

SEQ ID NO: 375314 - DNA, 708 bp, Homo sapiens
  misc_feature: GZ8MTXP01BQJHR.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgcccgccctcagtgtcgtcggggcccccagggcagagggtccaccatcctcctgcacgtgggaactagttacccaacgagtcggggactaaggttaataagtgtaacacgtacgggtaaccagacctaaccttaccgaaggaaaccaccgacccccctaaactccctacactaccatacgactaaccagaaacgtccggcccgtccgggggtcccccctggaccgtattcctcgtacggcctccgaagtcctagaccctacttaccgaccgtcccctcccgtcggaccctacgtcccgtaccgtcgggtaccctaccgacgtaccgtagggaacggtagttacggacgggtacttacggtaacctttacgttaccgtacggaccctacggttaccctaagtacgtaaccgacggtccgaacggtcgttacgaccgttcggttcgtttcgggtttcggggtttccggggccgggttaccgggtaaccgacggtccgtccgggtacccgttaccggtaaccggttccgtaacccgg

SEQ ID NO: 375315 - DNA, 571 bp, Homo sapiens
  misc_feature: GZ8MTXP01D4TDK.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggcccagggcagaggtcaccatctcctgcactgggaacagttccaacagtcgggcaggttataatgtacactggtaccagcaacttccaggaacacgcccccaaactcctcactcccatgactaccaagaaactccccggacccgtcgggggtccctcgaccgtaacttctcgtggccttaccacgtctcgactacttcacgtccctcccgtcggtccatccacgtcgggcctaccgacgacgtaggaaggtagtggaacggtcgtagacttacttaacgttcgacctacgtcctatcgacgaacgcgagggcttcgtacgtgccgttggttcgggtttcggcgggtccggacgacgttcgtcggaaccgttccg

SEQ ID NO: 375316 - DNA, 622 bp, Homo sapiens
  misc_feature: GZ8MTXP01APCMX.51.82.H05.1.454.CMB.2.raw
  modified_base (532)..(532): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggagatcctcttctggtggcagcaaccacgaggacgcccactcccaggtcgcagtctggtgctagtcgtgggactggaggtgaagagcgtgggctcgagtgaacggtctccgtgactaagtcttctggacctactaccttacaccgtactactatgtcgactacggtcggacaccccggacgtacggcccgtaggacgtaaagggtctaaggagtagggtagtgggtagttagggacttaccggaaccgtaaagtaacgtcgaacgaactaacgtaaaacgtgtacgtaacgtacgtacgttaccgttaggaacggttcggtacggcaccgtagacgacgagtacaactactctacaccganaacctgacttaccgaagtcggtaacgttaccggcacccggtaacgacccgtaacgaaccggccgttaaccggggttcgtttcggtttaag

SEQ ID NO: 375317 - DNA, 599 bp, Homo sapiens
  misc_feature: GZ8MTXP01AQKYC.51.82.H05.1.454.CMB.2.raw
  modified_base (99)..(99): a, c, t, g, unknown or other
  modified_base (207)..(207): a, c, t, g, unknown or other
tcagcgatcgtatacacgaccggtgctcgatttagtcgagctctctcgcgggcacgaccggtgctcgatttagtcgagctctcagagagaaagggggancatcacccagcaaccacatctgtcctctagagaatcccctgagagctccgttcctcaccatggactggacctggagatcctcttcttggtggcagcaaccacaggacnccccactccccgaggtgcagctggtgcagtctgggactgaggtgagagctgggctcgagtgaaggtctcctgacaagtacttcgtaggactacaccttcaccgactactatatcgcacgtgggtgccccgacgacggaccccgtaggacgaaacgggcttggacgtggagtgggatgggataccgaacccgtaagagtggtacgaccaacaaaccgtatcgacacgacgtacgttttcgacgggtcggtacggggtaccacctacgtaccgaccgacgaccgaacaacctattacacgaccaaacaacgagttaccaacgtagtacgggttacggttcgaaccgtcgaccgtaacgaacccgtacgttaccgggtccgttaagtttttaagg

SEQ ID NO: 375318 - DNA, 787 bp, Homo sapiens
  misc_feature: GZ8MTXP01EIS3U.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcggggccccagggcagaggtcaccatcctcctgcacgtggaacagttccaacgagtcggggctaggttaataagtgtaacacttaggtaaccagacctaaaccttccaaggaaaccaccgaccccccaaaacttcccctacaacttacccaagttacgaaactaaccgaaacggtaaaacgtccccgggaccccggttccgggggttacccccccctacggaaacccgttatttcccgttccgtccgggtacccttcccgaaacgttccctacgtaaccctaacctttccgaaccgtcccccttccccgttacgggaccctacgttacccgaaccgttcggggtacccttaccggtaaacgaaccgttacgggaaacggaacgttagggaacgggtcgttaacggtaacccgtttaatttaaccgttcggaacccgtacgttacccttaagttacgtaacgacggtaccgaagggtccttaggttaccgtggttccgtttaggggttttcgggtttaccgggccggggttaccggaaccgtaaaggtcccggtttaaccgacccgggtttaccgtaacgggttaaccgaaccccgg

SEQ ID NO: 375319 - DNA, 693 bp, Homo sapiens
  misc_feature: GZ8MTXP01B3AIE.51.82.H05.1.454.CMB.2.raw
  modified_base (241)..(241): a, c, t, g, unknown or other
  modified_base (260)..(260): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctctgcacgtgggaacagttccaaacngtcggggctaggttataangtacactgtacagcaactcaggaacacgacccccaaatcctacactccatacgaactaccaagtaaacgtccggacccgtccgggggtaccccctggaccgtatttcctacgtcggtacctccgaagtcctacgacctacctttacgaccgtccccttcccgtcggacccactccgacgtcgggacccttaccgacggtaccgtacggaggtacgttacgggacggtcttacggtaacctttacgttaccgttacgcccgtaacggttacccctaagttacgtaaccgacggaccgtacgggtaaccgtcgttacgttcggttcggtttcgggtttcgggggttttcccgggaccggggttacccggggtaacccgtaacgggtccgttacccggggtacccgttacccggtaacgggttccgtaaccccggg

SEQ ID NO: 375320 - DNA, 642 bp, Homo sapiens
  misc_feature: GZ8MTXP01DH706.51.82.H05.1.454.CMB.2.raw
  modified_base (550)..(550): a, c, t, g, unknown or other
  modified_base (604)..(604): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacagggacgccccactcccaggtcgcagctggtgcagtctgggactgaggtgaagagcgtgggcctgagtgaaggtctccgtgacaagtacttcgtaggtactacctaccttacaaccgtacttaactatatgactacggtggcgtacccgacgaccggtccccgtaggaacgtaaacgggtcttaaggaggtagggagtacggggatagggaactaccggaaaccctaaaggtaagtcgggtacacccgaaataaacgtagtacgactacctaagttacgtttacggacgggtcggtaacggggttcaaccgttagaccgaccgacgaccgtaaacactaacttacgaanaccaaacacgttagttacccagtagtacgggttacgttcgaacctcggtacccncgggaacccgaccgttacggggtcctttgttttaaggg

SEQ ID NO: 375321 - DNA, 670 bp, Homo sapiens
  misc_feature: GZ8MTXP01EIV4U.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggacgcccactcccaggtgcagctggtgcagtctgggactggaggtgaagagcgtgggctcgagtgaagtctcctgacaagtacttcgtggaactacctaccttacaccgtactactatatgactacgtgggtcgcccgacgacggccccgtaggaacgaaaggggtcttggagtgggagtggggtagtgggactaccggaaccctaaagagtgggtacgaccgaaactaaaactacgtagaccaacgtaacgttaaccgttttacggaacggggttccggttacggggtaccctaacccgaacgttaccgaaacccgaacggaccgaaaccactaacgttacctaacggaaccaaaaccaacgttacggtaaccttaaccggaagttacgggttaacgtttccgaacccgaacgggtcccctaacggaccccgtacggttaaccgggtccgttttaaggttttaagg

SEQ ID NO: 375322 - DNA, 555 bp, Homo sapiens
  misc_feature: GZ8MTXP01AQBEA.51.82.H05.1.454.CMB.2.raw
  modified_base (234)..(234): a, c, t, g, unknown or other
  modified_base (379)..(379): a, c, t, g, unknown or other
  modified_base (422)..(422): a, c, t, g, unknown or other
  modified_base (441)..(441): a, c, t, g, unknown or other
  modified_base (474)..(474): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcgggccccagggcagaggtcaccatctcctgcacgtgggaacngttccaacgagtcgggggcaggtttaataatcgtaacacgtaggtacccagacctaaccttccaaggaaaccaccgaccccccaaactccctcactccatagactaccagaaactccggcccgtcggggtcccccagacgattcncgtgcctcagtctgactactcacgccctcgtcgccatcgacgnggacctcgagactgagtanggagtcgtacgtatactacgtcgccagtcctancgacagccaggctgacgtgcgttggttcgggttcggcggaccggaacagtccgtcgaccggttccgtaacgttccgaaccg

SEQ ID NO: 375323 - DNA, 591 bp, Homo sapiens
  misc_feature: GZ8MTXP01CWLQA.51.82.H05.1.454.CMB.2.raw
  modified_base (245)..(245): a, c, t, g, unknown or other
  modified_base (253)..(253): a, c, t, g, unknown or other
  modified_base (369)..(369): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactggacgcacgcccgccctcagtcgtcgtcggggccccagggcaggacggtcaccatctcctgcacgtgggaacngtaccaangtcgggcaggttataatgacactggtaccagcaactcagacacgaccccaaatccacactccatagaactaaccagaaacgtcccccggccgtcggggtccctacgacctacttcncgtcgcctacaagtctacgactacttcacgtccctccgtcgcctacgtacaccgtcggacctccgagacctaggacggtagtacggacggtcctacgtaaccttattaaccgtcgtaccgtacgtacccttagacgacgaacgtcgacggtcttcgtacgtggttaccgttggttcgggtttccgggacgggtcggaccgagttccgtcggttccgttccgg

SEQ ID NO: 375324 - DNA, 726 bp, Homo sapiens
  misc_feature: GZ8MTXP01DS6KI.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcgggccccagggcagaggtcacatctctgcactgggaacagtccaacagtcgggacaggttataatgtacacgtggtaccagcaacttccaaggaacaccgacccccaaactccctacactccatacgaactaaccgaagtaaacgtcccccgggccccgttccgggggtaccctcggacccgtaacttccgtcgtcggacccttaccgtaacgtcctacgacctaccttaccgaccgtcccctccccgtcggaccctaacgtccgtaccgtcgggtaccctaccgaacgtaaccgtagggaacgggtaaggttacgggaacgggtaccttaacggtaaccgttaacgtttaccgtacggtacccctaacggttacccttaagtaccggaacgtaacggaccgttacgggtcccttaggtaccgttcggttccggtttcgggtttccggggttttccccggggaccggggtaacccggggtaacccgtaacgggttcccgttaaccgggttaaccccggtttaaccccgg

SEQ ID NO: 375325 - DNA, 715 bp, Homo sapiens
  misc_feature: GZ8MTXP01CCVC4.51.82.H05.1.454.CMB.2.raw
  modified_base (269)..(269): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaactcccctgagagctccgttcctcaccatggactggacctggagatcctcttcgttggtggcagccaaaccacgaggacgccccactcccgaggtgcagcgtggtcgcagtcgtgggactggaggtagaagacgcgngggcctgagtgagtctcgtgactagtcttgagtactacctaccttcaacccgtactaactatagtcgacgtacggttggggtacaccccggaaccgaccgggccccgtaggaacggtaaacgggtcgttgggaggtaggggtaggtagggacgtacgggactacccggtaaacccgttaaaggtaacggttcgggaccgaaaccctaaacgtaaaacgtacgtacgaaccgtaacgtacgtttaaccgttttacggggacgggttaccggggtacgggttaacccaacgtacggtaccgaacccgacggaaccgaacctacctacgtaaccgtacgaaacctaaaccgtcgttaacggttacaacgttaaggtggttaacgttccgacccgtaagtcccgtaacggtaacccggcggttaacccggttcgttttcgggtttttaag

SEQ ID NO: 375326 - DNA, 653 bp, Homo sapiens
  misc_feature: GZ8MTXP01DRBJG.51.82.H05.1.454.CMB.2.raw
  modified_base (294)..(294): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagccaaccacaggacgccccactcccaggtgcagctggtgcagtcgtgggactggaggtagaagagccgtgggcctcgagtgaagtctcgtgacaagcttngatacctaccttcaccgtactactatatgctagtgggtcgacccgacgacggccccgtaggaacgaaagggtcttggagtgggagtgggagtacgggactaccggaacccgtaaagaacgtgggtacgaccctaaactaaaacgtacgtacgaccgtaacgtacgttaaccgttttacggaacggggttcggttacggggttaccaaccgtaacgtaccgaaccgaacggaccgaactaaccgtaacttaccgaacgaacctaaaactacgttacgttaccgttaacgtagtagggttacgttcgaaccgtaacgtcccgtaacggacccgtacgttaccggttcgtttgtttttaacg

SEQ ID NO: 375327 - DNA, 601 bp, Homo sapiens
  misc_feature: GZ8MTXP01D8P4K.51.82.H05.1.454.CMB.2.raw
  modified_base (188)..(188): a, c, t, g, unknown or other
  modified_base (250)..(250): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctnagtgtcgtcgggccccagggcagacggtcaccatcctcctgcacgtgggaacagttccaacngtcggggcaaggttataatgtaacacgtggtaccagacaaacttccaaggaaccaccgaccccctaaactccctacactccatagaactaaccagtaaactcccccggacccggtcggggtaccctgacccgtaattctcgtcggcctacaacgtctacgactacttcacgtccctccgtcgccatccacgttcggcctacgacgtacgtagaggtacgtaggtacgggtaccttacgtaaacttacttaccgtcgtacctacgttacccgtatcgaacgaacgtcgacgggtcttacgcgtggttcgttggttcgggttcggcggtcgacgagcgtaacgccgttaaccg

SEQ ID NO: 375328 - DNA, 778 bp, Homo sapiens
  misc_feature: GZ8MTXP01ERK7H.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgccgccctcagtcgtcgtcggggccccagggcaggacggtcaccatctcctgcacgtgggaactacgttccaaacgacgtcggggactaaggttaataagtcgtaacacgttacggtaaccagacctaaaccttaccgaacggaaaccaccgaacccccctaaactccctacaactccgaatacgtaactaaccgaagtaaaccgtccgggtaccccgggttaccgggggttaccccccctacgggtaaccgttacgtttcccgtaccggttaaccgggtaccccttaacccgttaaacgggttccctaccgggtaaacccttacccgtttaaccgacccgttccccgtccccgtacgggtacccctacgtaccgtaaccggttcgggtaccctaccgtaacgtaccggtaggaacggtagtacgggtacggtccgttacggttaactttaaccgttaccgttcggaaccttaccgttaccctaaaggtcgtaacgtacgcgacggtcgtacgttaccgtggttccgtttgggtttcgggttcgggccgggttacggtaaccgtacgtccgtacggtaccgttacggtaacgttccgaacccgg

SEQ ID NO: 375329 - DNA, 626 bp, Homo sapiens
  misc_feature: GZ8MTXP01EJH3Q.51.82.H05.1.454.CMB.2.raw
  modified_base (189)..(189): a, c, t, g, unknown or other
  modified_base (331)..(331): a, c, t, g, unknown or other
  modified_base (427)..(427): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacgagggtcctgggcccagtctgtactgacgcagcccgccctnagtgtccgtcggggccccagggcagaggtccaccatctctgcacgtagggaacagttccaacgagtcgggcaggttataatgtaacacgtcggtaaccagaccaaacttcgaacggaaccaccgaccccctaaactccctanactcatgactacagaaacgtccccggacccggtcgggtcctcgaccgtaacttcgtcgtgcctccgaagtcctacgactacgttcacgtccctccncgccatcgactcggcctccaagtcgtagaggtacgtggacggtctacgtaacttacgttacgtacgtaccctacggtaccctagtacgggaccaagtcccgaaaggtcttacgtaacgtcgttcggtttcggtttcgggtttcccgggacgggtaaccggaacccggagttcccgtaacggttaaccccgttaacccgg

SEQ ID NO: 375330 - DNA, 661 bp, Homo sapiens
  misc_feature: GZ8MTXP01ARU6E.51.82.H05.1.454.CMB.2.raw
  modified_base (461)..(461): a, c, t, g, unknown or other
  modified_base (521)..(521): a, c, t, g, unknown or other
  modified_base (533)..(533): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcgttggtggcagccaaccacgaggacgcccactcccgaggtgcagtcgtggtgcgtagtcgtgggactgaggtgaagacgcgtgggcctgagtgaaggtcctcgtgacaagtcttcgtagactaccaccttacaccgtactacgtatagtcgacacggttgggcgacccgaccgcggaccccgtaggaacgtaaaggggtcttggaggtgggagtggggagtaggactaccggaacccgtaaagtagtcgggtacaacccgtaaacgtaaaacgttntacggacctaacgtacgttaaccgtttggacggggttaccgtcggggtacccaaccgtanaccggaacccgngaaccgaacctactacttacgaacgtaaccaaaacgtcgaacgttaccttaaacgagttacgggttacgttacgaccgtaacggccgttaacgacccgtacggttcccggttcgtttaagttttaagg

SEQ ID NO: 375331 - DNA, 638 bp, Homo sapiens
  misc_feature: GZ8MTXP01BHX02.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacgagggtcctgggcccagtctgtactgacgcacgccgccctcgagtcgtcgtcggggccccagggcagaggtcaccatctctgcacgtacggaacacgtaccaacgacgtcgggactaagttataatcgtacacgtacgtaccacgtacaaccttccgaacgaaccaccgaccccaaactcctacactcactacgactaaccaagtaacgtccccggcccgtacggggtccctacggtaccgtacttccgtcgtcgtacctaccgtacgttccgtacgtacctacgttccaccgtccctaccgtcgacctactaccgacgtcggacctaccgacgacgtaggacggaggtggtacggtcctacgtaccgttacgttccgtacggtacctacgtccgttaacgtacgacaagcgttacggtacttcggtacgtggttccgttgggttcgggttaacggcggtaaccgacgacgttcgtaacgttccgtaacg

SEQ ID NO: 375332 - DNA, 598 bp, Homo sapiens
  misc_feature: GZ8MTXP01CC4EX.51.82.H05.1.454.CMB.2.raw
  modified_base (182)..(182): a, c, t, g, unknown or other
  modified_base (238)..(238): a, c, t, g, unknown or other
  modified_base (264)..(264): a, c, t, g, unknown or other
  modified_base (286)..(286): a, c, t, g, unknown or other
  modified_base (479)..(479): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctnttcttggtggcagccaaccacaggacgcccactcccaggtgcagctggtgcagtcngggactggaggtgaagagcgtggctnagtgagtctctgactagactgngactactaccttcacgtactacgtatatgctacgtggcgccgacgcggcccgtaggacgaaagggtcttggagtggagtgggatgggactacgacctaagacgtggacgaccaacgaaacgtcgtacgacgaacgtagtaccgtttcgacgggtacgtcggggtacctaccgagtacgaccgacgacgaaccncgtactaccgtaagccaaaactaccgttagtaccttaacggtaaagtcgggttaaacgttccgaacccgaacgtcccgtaacggacccgtaccgttaccggtccgtttaagttttaagg

SEQ ID NO: 375333 - DNA, 654 bp, Homo sapiens
  misc_feature: GZ8MTXP01ED87S.51.82.H05.1.454.CMB.2.raw
  modified_base (188)..(188): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctnagtgtcgtcggggccccagggcagacggtcaccatctctgcacgtgggaaacagttccaagagtcgggacaggttaataatgtacacgtcggtaccagacaaacttccgaacggaaccaccgacccccaaactcctacacttccgatacgactaaccaagtaacgtccccggacccgttcgggggtaccctacggacccgtaacttcgtccgtcggtcctaccgtaaagttcctacgaacctcttaccgactcccctacccgtggacctagtcccgtacgttcggcctacgacgtactggaagtcgtggaggtctagaccttactacgtcgacctacgttcctagttaccgacgaacgcgttaacgggtccttagtcccgttggttcggtttacgggtttccgggttaaccgggtccgggaaccggttaacgacggttcgttaaccggttaacccgtttaacccgg

SEQ ID NO: 375334 - DNA, 624 bp, Homo sapiens
  misc_feature: GZ8MTXP01EP88G.51.82.H05.1.454.CMB.2.raw
  modified_base (282)..(282): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactgaggtgaagagctgggctcagtgaagtctctgcagctcngatacactcacgactactatatgcacgtggtcgccgacgacggccccgtaggaaccgaaaagggtcttggaggtagggagttggggattagggaactccggaacccgtaaagaacgtgggtacgaccaaacgtaaactatgacaacgaacgttactttacggaacgggtcgtacggggtaccaacctagtaccgacccgaaggaccgaaccaacgtaactaccgtaacgacctaaacgaacgttaacggtaccttaacgaagttacggggttagttccggaaacccgtaacgacccttaacggaaccggtaaccgaccgggttaacccgttgtttttaacgg

SEQ ID NO: 375335 - DNA, 646 bp, Homo sapiens
  misc_feature: GZ8MTXP01DP2EU.51.82.H05.1.454.CMB.2.raw
  modified_base (255)..(255): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgaccgcacgcccgccctcagttcgtcgtcggggcccccaggggcaggacgggtccaccattcctcctgcacgtggaacagttccaacngtcggggctaggttaataatcgtacacgtggtaaccagcctaaactccaaggaaaccaccgacccccctaaatcccctacaactccatacgactaaccagtaaacctccggacccgtccgggggtcccccctcggaccgtacttccgtcgtcggccttccgaagtcctacgacctacgttccacgtccccttcccgtcggcctactcaccgttcgggtaccttccgagaccgtaggagtacgtaggacggtcgtagtacttacttacgtcgcccgtagttcctaagtcgaacagccgaggtcctgcgttgttcgttgggtttacgggtttccgggccgggttacgggaacctagtccgtcggacccgttaccgtaacggttccgaacccgg

SEQ ID NO: 375336 - DNA, 549 bp, Homo sapiens
  misc_feature: GZ8MTXP01EJB4L.51.82.H05.1.454.CMB.2.raw
  modified_base (265)..(265): a, c, t, g, unknown or other
  modified_base (333)..(333): a, c, t, g, unknown or other
  modified_base (472)..(472): a, c, t, g, unknown or other
  modified_base (482)..(482): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactggaggtgaagagcgtgggcctnagtgaaggtctcctgcaagtacttctggataccaccttacaccgtactactatatgacacgtgggtcncccgacgacggcccctggacgaaaggggtcttggagtggagtgggatgggatccgacctaagagtgtacgacaacaaactatacgacacgtacgtactttacgagggtcgtgggtaccacagtacgacccagccgaacnctaacttcanacaaacacttagtccttagagtggacgttgaccgaagccgtaagaccgacgacggtcgttgtttaag

SEQ ID NO: 375337 - DNA, 661 bp, Homo sapiens
  misc_feature: GZ8MTXP01A666A.51.82.H05.1.454.CMB.2.raw
  modified_base (292)..(292): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactccccaggtgcagctggtgcagtctgggactgaggtgaagagcgtggggcctcagtgaaggtctcctgcaagtcttcgnggactaccaccttcaccgtactactatatgcacgtggggtgacccgacgacggccccgtagggaccgaaagggtcttggaggtgggagtgggagtgggactccgacccgtaaagaagtgggtacgacccaaactaaaacgtatacggaccacgtaacgttacgttttacggacggggtcggtacggggttaccaaccgtacgtacggaacccgacggaccgaaaccaacgtacttaccgtaacggaacccgtaaacaaccgttacggttaaccttaacgtagtagggttaaccgtttacgaaccccgaacggtcccgtaacggaaccccggtaccggttaccgggttaacccgtttggtttttaacggg

SEQ ID NO: 375338 - DNA, 755 bp, Homo sapiens
  misc_feature: GZ8MTXP01D4JCU.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtcgtcgtcggggccccagggcagacggtcacatcctctgcacgtggaacacgttccaaacgagtcggggactaggttaataatgtacacgtgtaaccagacaacttccaaggaaccacgaccccctaaatccctacactccatacgaactaccgaagtaaacgtccggcccgtccgggggttcccccaggtaccgtatttcctcgttacgggccttccgaaacgttccgtacgtaacctaccgtttacgacgtccccttcccgtacggaccctaacgttccgaacgtttccgggacccttacccgaacggtaccgtaggaacggtatacgggtaccgggtacttacggtaacctttaacgttaccgtcggtacccgtacgttacccgtaaagttcgaacgtacgaccggtacgggtaacctttcggaaccttcggggttccgttttacgggggttttccgggggtttttccgggggcccggggttacccggggaaaccccgtaaagggtcccgttaaccggggttaccccggttaccgggtttaaccgggttaacccgtaaaccccggggg

SEQ ID NO: 375339 - DNA, 674 bp, Homo sapiens
  misc_feature: GZ8MTXP01CUZPW.51.82.H05.1.454.CMB.2.raw
  modified_base (247)..(247): a, c, t, g, unknown or other
  modified_base (541)..(541): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgcccgccctcagtcgtcgtcggggccccagggcaggagggtcaccatctcctgcacgtgggaacagttccaanagtcggggactaggttataagtgtacacgtggtaccagtcctaacttccgaaggaaaccaccgacccccctaaatcccctacactaccatacgaactaccagaaacgtccggccccgtcgggggtccccctggacctagttcctcgtcggtcctccgaagtcctacgacctccttcgacgtcccctcccgtacggccctactccgtaccgtcgggacctaccgacgtacgtaggaggtagtcgacggtcgttaggtacttacttacgtcgcccgtagttcctaagtcggtaacncggacgcggtctcgttacgtcggttcgtttcggggtttcggggttttccgggggccggggttaccggggtaacccgtaacggtcccggttacgggtaccccggttacggttaacgggttaaccgtaacccggg

SEQ ID NO: 375340 - DNA, 713 bp, Homo sapiens
  misc_feature: GZ8MTXP01EM1XI.51.82.H05.1.454.CMB.2.raw
  modified_base (231)..(231): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtncagtctgggactgaggtgaagagcgtgggcctcgagtgagtctcctgacaagcttctggactacaccttcaccgtactactatatgactacgtggggtcgacccgtacgacggccccgtaggaccgtaaaacggggtctttaaggaggtggggtagtgggggtaataggggtacgtaccggtaaaccccttaaaggtaaacggttcgggtacggaccccaaagtaaaaccttagtacgacccaaacgttacgttaacgtttttacggacgggggttacccgggttagggggtaccctaaccgtaacgtacggaaccccgaacggacgaacctaacacttaaccgtaacgaccctaaaacaccgttaaacggttacccttaaacgacggttaagggttaacggtttcccgaacccgtaacgggtccccgttaacggacccccggacggttacccggggtaacccgttttaaggtttttaacgg

SEQ ID NO: 375341 - DNA, 649 bp, Homo sapiens
  misc_feature: GZ8MTXP01ED6ZG.51.82.H05.1.454.CMB.2.raw
  modified_base (99)..(99): a, c, t, g, unknown or other
tcagcgatcgtatacacgaccggtgctcgatttagtcgagctctctcgcgggcacgaccggtgctcgatttagtcgagctctcagagagaaagggggancatcacccagcaaccacatctgtcctctagagaatcccctgagagctccgttcctcaccatggactggacctggaggatcctcttcttggtggcagacaaccacaggacgcccactcccaggtgcagctggtgcagtcgtagggactggaggtgaagagccgtgggcctgagtgaaggtctcctgacaagtacttcgaggatacctacccttacgaccgtacttaacttaatatcgcctaggtgggtcgaccgaccgacggccccgtaggaaccgtaaagggtcgttggaggtgggtagtggggtagtacgggtaacttacccgaaaccgtaaagtaacgtcggggtacgaaccctaaactaaaccgtagtcgaaccgaacgttacgttaccgtttacggacgggtcggggttacggttaccaaaccgtagtaccgaacccgaggaccgaactactacgtactaaagacccaagtaacacgttacttacgaagttcgacgttcaccgaacgtcccaacggaccgtacgccggttaacgtttgttttaagg

SEQ ID NO: 375342 - DNA, 593 bp, Homo sapiens
  misc_feature: GZ8MTXP01CD6A1.51.82.H05.1.454.CMB.2.raw
  modified_base (419)..(419): a, c, t, g, unknown or other
  modified_base (425)..(425): a, c, t, g, unknown or other
  modified_base (504)..(504): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagcctccgttcctcaccatggactggacctggaggatcctcttcttggtggcagcaaccacaggacgcccactcccaggtgcagctggtgcagtctgggactgaggtgaagagccgtgggcctgagtgaaggtctcctgacaagtcttcgaggtactacctaccttacaccgtacttaacttatatgctaacggtggtcgacccgaccgacggcccctaggaccgtaaagggtcttggagtggagtggatcggatccgaactagaatggtagactaanaaactntagcagtacgtactttcgaagggtcgttacgggtcaacctagtcgaaccgagaccgaacactactctaaagcaaaaccncgttaacgtacttaagtaggttacggttacgttccaccgaacgtaccgtaacgacccggtaccggttaccggttcgtttaagttttaag

SEQ ID NO: 375343 - DNA, 542 bp, Homo sapiens
  misc_feature: GZ8MTXP01B5WS6.51.82.H05.1.454.CMB.2.raw
  modified_base (208)..(208): a, c, t, g, unknown or other
  modified_base (291)..(291): a, c, t, g, unknown or other
  modified_base (404)..(404): a, c, t, g, unknown or other
  modified_base (410)..(410): a, c, t, g, unknown or other
  modified_base (504)..(504): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacncccactcccaggtgcagctggtgcagtctgggactgaggtgaagagcgtgggcctcgagtgaaggtctcctgcaagacttcgngatacaccttcaccgactactatatgcacgtgggtcgcccgacacggcccctaggacgaaagggtcttggagtgggagtggggatggatacgacctaagaatggtcgaccaanaaactntgacacagtacgtttacgagggtcgtgggtaccaccagtcgaaccagacgaacactatactagactaacacagtcacgtagtggagttcgaccngcctaacgacccgacgttacgggtccgttgttttaacg

SEQ ID NO: 375344 - DNA, 583 bp, Homo sapiens
  misc_feature: GZ8MTXP01EN7DR.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaaacagtcggggcaggttataatgtacactggtaccagcaacttccaggaacacgacccccaaactcctcactccatgactaccagaaactccggacccgtcggggtccccctgacgtattcctcgtacggcctccgaagtctacgacctacttcacgtccctccctgaccctatcacgtcgggacctccgagactggagagtacgacggtccgtagtacttattactggccctagttccctatcgacagtcgaggctggaccttgcgttgggttcgggtttaccgggcgggttaccgggaaccgacggtccgtacggtacccgttccgtaacggttccgaaccgg

SEQ ID NO: 375345 - DNA, 736 bp, Homo sapiens
  misc_feature: GZ8MTXP01AU4KB.51.82.H05.1.454.CMB.2.raw
  modified_base (273)..(273): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcggggccccagggcaggaggtcaccatctctgcacgtagggaactacgttaccaacgagtcgggggactaggttaactaagngtaacacgttcggaaccacggactaaacttccaaggaaaccaccgacccccaaatccctacactccatacgaactaccaagtaaacgtcccggcccgtaccgggggtcccctacggaccgtacttcctcgtacggcccttccgaacgtcctagtacctaccttaccaacggtccccttccccgtggaccctacgtcccgtagttccggggacccttccgaacgtaccgtaggaaggtacgttacggaccggtcgttacggttaaacgttaacttaccggtccgtacctaacggttacccctttaaaggtcgtaaaccgacgtacccgaagggtcttaacggccgttcggttccggtttgggggtttaacccgggtttccgggggaccgggttaccccgggaaaccgtacgggttccgtaccccgggtaacccggttaccgttaacggggttcccgaacccggg

SEQ ID NO: 375346 - DNA, 610 bp, Homo sapiens
  misc_feature: GZ8MTXP01ETRUW.51.82.H05.1.454.CMB.2.raw
  modified_base (239)..(239): a, c, t, g, unknown or other
  modified_base (247)..(247): a, c, t, g, unknown or other
  modified_base (531)..(531): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagcccgccctgagtgtcgtcgggccccagggcagaggtcaccatctactgcacgtgggaacngtaccaanagtcgggactaggttataatgtaacagtcggtaccagactaactccaaggaacaccgacccccaaactccacactccaatacgactaaccgaagaaccgtcccggaccccgtcgggggtccctaggacccgtaacttccgtcgtacggtccctaccgtaagttcctacggtaacctaccttaccaccgtcccctacccgtcggaccctacgtaccaaccggtcggtcaccgacgtcgtagacggagtcgaacggctacgtactacgtctacgacctacgtctancgactgcaggtcttagtcgtcgttcgttggttcgggttcggacggtaaccggtacacgttccgtcgttaacccgtaacg

SEQ ID NO: 375347 - DNA, 644 bp, Homo sapiens
  misc_feature: GZ8MTXP01B8LCC.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggacgcccactcccaggtgcagctggtgcagtcgtgggactgaggtgaagacgcgtgggcctgagtgaggtctccgtgacaagtcttcgtagactacctaccttacaccgtactaactatacgtcgactacggtgggtacgacccccggtaaccgacgggtcccccgtagggaaccgtaaacggggtccttgggaggtagggtaggtggggagtacgggtacgtacccgtaacccgtaagacgtggtacgaccaactaaacctgtacgacaacgtagttacctttacggacggtcggtacggggtaccaccgtagtccgaaccacggaccgtaactactacgtactaaacgaccaaacacgttactacgttacgtacgtagggttacgttcgaccgtcgaccgtaacgccccgaaggttaccggttccgttaagtttttaag

SEQ ID NO: 375348 - DNA, 640 bp, Homo sapiens
  misc_feature: GZ8MTXP01BLZ2F.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggacgcccactcccaggtgcagctggtgcagtctgggactggaggtgaagagcgtgggcctagagtgaacggtctccgtgacaagtaccttcgtaggactaccctaccttacaacccgtacttaactattacgtgactacggtgggtcgacccggacgacggccccgtagggacgtaaacgggtcgttgggagtacgggtagtggggtagtacgggacgtaccgaacccgtaagaagttcggtacgaaccaaactaaaacgttgtacgactaacgtagttacgtttacggacgggttcgtacgggttacaccgtacgacgaccgagacgtaacactctaccgacgaaccaactcggttactacttacgagtacgggttagttccgaccgtcgacccgtcggacccgacgggttaccgttccggtttaagttttaacgg

SEQ ID NO: 375349 - DNA, 718 bp, Homo sapiens
  misc_feature: GZ8MTXP01CK3YR.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgcccgcctcagtgtcgtcggggccccagggcagacggtcaccatctcctgcacgtgggaacacgtaccacagtcgggacaggttataatgtaacacgtacggtaccagaccaacgttaccaacgaaccaccgaacccccaaactcctaccacgtaccctatacgaactaaccaacgtaaaccgtcccccgggtaccccggtacgggggtacccctacggtaacccgtaaactttccgtccgtcgggtacctaaccgtaacgtccgtacgtacctaacgttccaccggtccctcccgtacgacctactaccgtacgtcgggtaccctaccgaacgtacgttacgggaacgacggggtacggtaggaccgttacgtaccgttaacttaccgtcgtaccgtacggttaccctagtacgacgtaacggcgttaaccggggttcgttacggttcgttcggttacggtttcggggttccggggtttccggggaccgggtaaccggtaaccgtacggttcccgttaaccgggttaaccgtaaccgg

SEQ ID NO: 375350 - DNA, 593 bp, Homo sapiens
  misc_feature: GZ8MTXP01B8FG4.51.82.H05.1.454.CMB.2.raw
  modified_base (266)..(266): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacagggacgcccactcccaggtgcagctggtgcagtctgggactgaggtgaagagccgtgggcctnagtgaaggtctcctgcaagtcttcgtggataccaccttcaccgtactactatatgctacgtgggtcgaccgacgacggccctagggaccaaagggcttggaggtggagtggggatgggactaccgacctaagacgtggtcaccaactaaacgtatcgacactacgtactttagacgggtcgtacgggtcaccgtagtacgaccgagacaacgactaatactacgacctaaacacttaaggtcttaacgtaggtacgggttaacgttccgaacccgtcggaccctaacggaaccccggacgttaccgggtccgtttaaggttttaacg

SEQ ID NO: 375351 - DNA, 701 bp, Homo sapiens
  misc_feature: GZ8MTXP01EONCW.51.82.H05.1.454.CMB.2.raw
  modified_base (188)..(188): a, c, t, g, unknown or other
  modified_base (246)..(246): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctnagtgtcgtcgggccccagggcagaggtcaccatctctgcacgtgggaacagttccaangtcgggacaggttatatgtaacacgtggtaccagactaacctccgaaggaaccaccgacccccaaatcctacactccatgaactacgaagaaacgtccccggcccgtcgggggtccctgacccgtaacttctcgtggcctaccgaacgtctacgactaccttcacgtccccttccgtcggccctatacccgtacgttcgggaccttaccgaagtaccgttagggacggtaggtacggtaagggtaccttacggtaaccgttaacttacccgtacgtacccgttacggttaccccttagtcgaaccgaagtcggttaacgggtccgttaacggtaccgttcggttcgggttttcgggttttaccgggggtttttcccggggcccggggtaacccgggggtaaccgtaaaccgggttcccggtttaaccgggttaacccccgggttttaacccgggg

SEQ ID NO: 375352 - DNA, 679 bp, Homo sapiens
  misc_feature: GZ8MTXP01EJSZ8.51.82.H05.1.454.CMB.2.raw
  modified_base (577)..(577): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgcccgcctcagtgtccgtggggccccagggcaggaggtccacatcctctgcacgtagggaactagttaccaaacgagtcggggactaggttaataagtgtacacgttacggtaaccagacctaaaccttaccgaacggaaaccaccgtacccccaaactccctacaactccagtacgaactaaccaagaaaccgtccgggccccggtacgggggtcccccaggtaccgtattccgtcgtacggaccttaaccgaagtcctacgaccttaccgtcacgtccccttcccgcgaccctagtccacggtcggtaccctacgagacgtaggacggtataggacgttcgtacgtaacttaacttacgcgtaccgttacgttacctaagcgtaaccgacgcgtaacggtntacggttctcggttcgttggggtttacggggttcccgggcggggaccggaaccttacggtccgttacggtaccccggttcggttaaccgcccgtaacccggg

SEQ ID NO: 375353 - DNA, 579 bp, Homo sapiens
  misc_feature: GZ8MTXP01BINXW.51.82.H05.1.454.CMB.2.raw
  modified_base (330)..(330): a, c, t, g, unknown or other
  modified_base (416)..(416): a, c, t, g, unknown or other
  modified_base (470)..(470): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagccgtggggcctcagtgaaggtctcctgcaagacttctggactacaccttacaccgactactatatgcacgtgggtcnccgacacggcccctggaccgaaagggtcttggagtgggagtgggatgggactacgaaccctaagaagtggtacgaccaacaaactntacgacaactacgtactttacgacgggtcgtcgggtacaccgacgtcgaaccgngacgacactactacgtaacgcaaacacagtcttaacgtagtaggttacgttcgacccgtaagcccgtaacgaacccggtacggttaccgggtcccgtttggttttaagg

SEQ ID NO: 375354 - DNA, 617 bp, Homo sapiens
  misc_feature: GZ8MTXP01A87LG.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggacgcccactcccgaggtgcagctggtgcagtcgtgggactggaggtgaagagccgtagggctcgagtgaagtctctgcaagtcttgtgactaccaccttacaccgtactactatgtgctacgtgggtcacccgacgacggccccgtaggaccgtaaggggtctggagtaggagtgggattgggaactacccgaacccgttaaagaaacggtcgggtacaaccctaaactaaaaccgtgtaccggactaaccgtaagttcccttttacggacgggttcgtcggggtaccacgtacgcacccgagtaccgacactacgtacaacgacaactagttacgtccttagacgtggttacgttccgaccgtaacggccctaacggacccggtaggaccccggtcgttttaagttttaacg

SEQ ID NO: 375355 - DNA, 702 bp, Homo sapiens
  misc_feature: GZ8MTXP01AQIOJ.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagaggtcaccatctctgcactgggacagttccaacagtcgggcaggttataatgtacactggtaccagcaacttccgaggaacacgcccccaaactcctcacttcccaatgaactaccgaagaaacgtccccggaccccgtcgggggtaccctggacccgtaatttccctcgttcgggcctacccgtaaacggtcttacgacctaacctttccgacgtcccctcccgttcgggaccctaacttcccgaccgtttcggggacccttacccgagtacccgttaggacggtacggtaggtaaccgggcttacggtaaccgtttacttaaccgtcgtacccgtacggttacccctaagttcgaaccctaaggtacaacgggtcgtttacggacccggttggttccggtttcgggtttcggggtttttaacccgggggcggggtaaccggggtaacccgtaaacggggttccgtaaccggttaaccccgggtttcccgggg

SEQ ID NO: 375356 - DNA, 706 bp, Homo sapiens
  misc_feature: GZ8MTXP01BG3DY.51.82.H05.1.454.CMB.2.raw
  modified_base (295)..(295): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggagatcctcttcttggtggcagccaaccacgaggacgcccactcccgaggtcgcagctggtgcagtcgtgggactggaggtgaagagcgtgggcctcgagtgaagtctccgtgacagtcttcgngataccaccttcaccgtatactatactgacacgtgggtcgaccccgacgaccgggtccccgtagggaaccgaaaaggggtctttaagggaggttgggagtggggtagtacgggtactacccggacccgtaaagagtgggtacgaccaaacgtaaacttgtacgacgacgtaagttaccgttttacggacgggttacggggttcgggttacccgaaccgtacgttacggaaaccccgtaacggaccggtaaaccaaaccgttagttaacccgtaaccggaaccctaaaaccgaaaccgttacgttaaaccttaaccggacggtttaagggaccgggtttacacccggtaagtaccccgtccgggtaaaccggtcccgttaccggggttaacccgttttaaggtttttaacgg

SEQ ID NO: 375357 - DNA, 687 bp, Homo sapiens
  misc_feature: GZ8MTXP01EVBA0.51.82.H05.1.454.CMB.2.raw
  modified_base (99)..(99): a, c, t, g, unknown or other
  modified_base (208)..(208): a, c, t, g, unknown or other
  modified_base (225)..(225): a, c, t, g, unknown or other
  modified_base (343)..(343): a, c, t, g, unknown or other
tcagcgatcgtatacacgaccggtgctcgatttagtcgagctctctcgcgggcacgaccggtgctcgatttagtcgagctctcagagagaaagggggancatcacccagcaaccacatctgtcctctagagaatcccctgagagctccgttcctcaccatggactggacctggagatcctcttcttggtggcagccaaccacaggacnccccactccccgaggtncagctggtgctagtcgtgggactggaggtgaagagcgtgggcctgagtgaagtctcgtgcaagtcttgagatacctccttaccaaccgtacttactatacgtgacctacgttggggcnccccgacgtaccgggtcccccgtagggaacccgtaaaaggggtctttaagggaagggttagggagggtggggtaagttacgggaacgttacccggtaaacccgtaaaggtacgttacggggtaccaaccctaaataaaaccgtagtacggaccctaagtacgttacgttttacggaacgggttcggtacggtaccaaccgtacgacgacccaggtaccaaacgactaactacgtaacgacaaactacgttacgtaaccttaagcgttaagggttacgttaaccggaccaacgggtccctaacggacccggtacgttaccgggttccgttttaaggtttttaagg

SEQ ID NO: 375358 - DNA, 602 bp, Homo sapiens
  misc_feature: GZ8MTXP01ERR8F.51.82.H05.1.454.CMB.2.raw
  modified_base (292)..(292): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactccccgaggtgcagcgtggtgctagtcgtgggactggaggtagaagacgcgtgggctgagtgaagtctctgcaatctcngataccaccttcaccgtatactatatgcagtggtcaccgacgacgccctaggacgaaagggtcttggagtggagtgggatgggactccgtaacctaagagtgggacaccaactaaactgcgacaacgtacgttactttcgacgggttcggtcgggtaccacgtacgacgaacccaggaccgaacctaactacgttaccaacgaccaaacgacttacggtacttaacgtaggtacgggttagttccgaaccgtaacggacccgtaacggaacccggtacggttaccccggttaacggttttgtttttaagg

SEQ ID NO: 375359 - DNA, 610 bp, Homo sapiens
  misc_feature: GZ8MTXP01C6YOW.51.82.H05.1.454.CMB.2.raw
  modified_base (264)..(264): a, c, t, g, unknown or other
  modified_base (288)..(288): a, c, t, g, unknown or other
  modified_base (314)..(314): a, c, t, g, unknown or other
  modified_base (396)..(396): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactgaggtgaagaagcctgggctnagtgaagtctcctgacaagacttnggatacaccttacacactactatatnctatcgggtgcccgacgacggcccctaggacaaaagggtcttggagtgggaatcggggatgggatcgaaccttaagatgganacaacaaagtatagacacagtactttagacggggtctcggggtaccacaaacgtcggaaacccagggacgtaaaccataacttaccaaggacaaaaccgacttaaagggttacccgtttaaacgtaggtacggttaacggttaccgaaccgtaaccggtacccgtaaccggaacccgggtaaccgttaccgggttccggtttaagttttaacgg

SEQ ID NO: 375360 - DNA, 616 bp, Homo sapiens
  misc_feature: GZ8MTXP01APSSL.51.82.H05.1.454.CMB.2.raw
  modified_base (247)..(247): a, c, t, g, unknown or other
  modified_base (463)..(463): a, c, t, g, unknown or other
  modified_base (589)..(589): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcggggcccagggcagaggtcaccatctcctgcacgtgggaactagttaccaaacgngtacggggctaggttaatatcgtacacgtggtaccagctaacttccgaaggaaccaccgacccccaaactcctacactcccatcgaactaccaagaactccggacccgtccggggtcccccagcgtattcctctacgggcctaaccgactctacgacctacttcacgtccccttccgtgacctacgtcacggtcggtaccctacgtacggtaccgnggaggacgttagacgggtctacggtaacttacgttaccgtcgacccgttacgttccctaagttcggaccacggtacgacggtcgtcgttacgtcgttccgttggttcgggttcggcggaccggaanacgtcgacgtcgcgtgttccgaaccgg

SEQ ID NO: 375361 - DNA, 738 bp, Homo sapiens
  misc_feature: GZ8MTXP01BWRYI.51.82.H05.1.454.CMB.2.raw
  modified_base (183)..(183): a, c, t, g, unknown or other
  modified_base (236)..(236): a, c, t, g, unknown or other
  modified_base (388)..(388): a, c, t, g, unknown or other
tcagcgatcgtatacacgaccggtgctcgattttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctnagtgtcgtcggggccccagggcaggaggtccacatctcctgcacgtgggaacncgttccaacgagtcggggactaggttataagtcgtacacgtcggaccagactaaccttcaaggaaacaccgacccccaaactcctacactccattacgactacgaagtaaacgtccggacccggttccgggggtaccccctaggaccggttnttccgtcgtaacgggccctaaccggaaagtccgtacgtaacctactttccgacgcccccttaccgttcggaccctacgtaccgtacgttccgggacttaccgtaacgaccggttaggacggtagttaaacggacgggtcgtacggttaaacgtttactttaaccggttaacggcccctaaacggttcccttaaaacgttccgggtaactacgtaccgggaacgttaacgtacggttacgttcgggttcgtttacggggtttccgggggttttccggggaccgggttacccgggaacgttaccggccggtaaccgggttcccgttaccgtaacgggttccccgaacccggg

SEQ ID NO: 375362 - DNA, 478 bp, Homo sapiens
  misc_feature: GZ8MTXP02GH614.51.82.H05.1.454.CMB.2.raw
tcagcgatcgtatacacgaccggtgctcgatttagtcgagctctctcgcggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatccatgataccagaaatccgccctcggggtcctgaccgattctctgctccaagtctgacacttcagccctccctggcccatcactggctccagactgagatgagctgactatactgccagtcctatgacagcaggctgactgctgtgtttcgcgcggacagctgacgtcg

SEQ ID NO: 375363 - DNA, 505 bp, Homo sapiens
  misc_feature: GZ8MTXP02FPTGB.51.82.H05.1.454.CMB.2.raw
  modified_base (401)..(401): a, c, t, g, unknown or other
  modified_base (461)..(461): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctggggactgaggtgagaagcctggggcctcagtgaaggtctcctgcaagacttctggatacaccttcaccgactactatatgcactgggtgccgacacggcccctggacaagggcttgagtggagtgggatggatcgacctaagaatggtgcacaaactatgacanagtactttcagggctgggtcacatgaccagcgacacatactagcaaacacagtcctaaanatcggacgtagacaagcctacgaccgacgtacggcgttagttag

SEQ ID NO: 375364 - DNA, 493 bp, Homo sapiens
  misc_feature: GZ8MTXP02JT702.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacagtcggggcaggttataatgtacactggtaccagcaacttccaggaacacgccccaaactcctcatccatgataccagaaactcccggccctcggggtccctgaccgattctctggctccaagtctgacacttcacgcctccctgccatcactggctccagactgaggatgagctagactattactgccagtcctagtgacagcaggctgctgcttgtggtttcgcggtcggacagctacgacgtacg

SEQ ID NO: 375365 - DNA, 556 bp, Homo sapiens
  misc_feature: GZ8MTXP02HBU75.51.82.H05.1.454.CMB.2.raw
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcaggagggtcaccatctcctgcactgggaacagttccaacagtcggggcaggttataatgtacactggtaccagcaacttccaggaacacgcccccaaactcctacatccatgactaccagaaatccggcccgtcggggtccccctgaccgtattcctcgtggctccaagttcacgtaccacttcacgtccctccctcgtcccactcacgtcgggcctaccgacgacgtgaggagtaggaggcgtgtacttattacgtcgaccgacgtcctatcgacagacgaggtctcggactcgtcgttggtcggtttcggcggtcgggaacgacggcgtacggaccgtaccgtacggtcacgg

SEQ ID NO: 375366 - DNA, 489 bp, Homo sapiens
  misc_feature: GZ8MTXP02FHJRZ.51.82.H05.1.454.CMB.2.raw
  modified_base (240)..(240): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaanatcggggcaggttataatgtacactggtaccagcaacttcaggaacagcccccaaactcctcatccatgataccagaaatcggccctcggggtccccctgaccgattctctggctccaagtctgacacttcagcctccctgccatcactggctccagactgagatgaggctgactattactgccagtcctatgacagcaggctgactgctgtgtttcggcgcggaaccgaagctgaccgtcaggtcacg

SEQ ID NO: 375367 - DNA, 513 bp, Homo sapiens
  misc_feature: GZ8MTXP02IHW5P.51.82.H05.1.454.CMB.2.raw
  modified_base (230)..(230): a, c, t, g, unknown or other
  modified_base (323)..(323): a, c, t, g, unknown or other
  modified_base (386)..(386): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtncagtctggggactgaggtgaagagctggggctcagtgaaggtctcctgcaagactctggatacaccttcaccgactactatatgcactgggtnccgacacggcccctggacaagggcttggagtggagtgggatggatcgacctaagatgtgcaanaaactatgcaacagtacttttacgagggtctgggtcaccatacgaccgagacgacacatacagacaaacacagtctaacatggagttcgaccaagcctacgacccgacgaccggtccgttagtttag

SEQ ID NO: 375368 - DNA, 502 bp, Homo sapiens
  misc_feature: GZ8MTXP02H19DM.51.82.H05.1.454.CMB.2.raw
  modified_base (410)..(410): a, c, t, g, unknown or other
  modified_base (430)..(430): a, c, t, g, unknown or other
  modified_base (432)..(432): a, c, t, g, unknown or other
  modified_base (439)..(439): a, c, t, g, unknown or other
tcagcgatcgtatacacgaccggtgctcgatttagtcgagctctctcgcggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctgggccccagggcagagggtcaccatctcctgcactgggaacagttccaacatcggggcaggttataatgtacactggtaccagcaacttccaggaacacgccccaaaactcctcatccatgaataccagaaatcccggccctcggggtccctgaccgtattctctggctccaagtctgactactcacgcctccctggccatcactcggctccagacngagatgagctgactattacncncatctangacacgacgagctcgctcgtcgtggttcggttcggcggacggacgacgtcgtacgtaccgtcg

SEQ ID NO: 375369 - DNA, 507 bp, Homo sapiens
  misc_feature: GZ8MTXP02FX9SI.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatccatgataccagaaatcggacccctcgggggtccccctgaccgattctctcggctccaagtctgaccacttcagccctcctgccatcactgggctccagactgacgatgaggctgactattactgccagtcctatcgacagcaggctgactgctgttcggtttcggcggtcgggaacagctcgaccgtcgtacggtcaccgg

SEQ ID NO: 375370 - DNA, 500 bp, Homo sapiens
  misc_feature: GZ8MTXP02JQSWS.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatccatgactaccagaaatcggccctcggggtccccctgaccgatctctggctccaagtctgacacttcagccctccctgccatcactggctccagactgagatgaggctgactattactgccagtcctatgacagcaggctgcctgctgtcggtttcggcggtcgggccaagctcggaccgtccgtaggtcaccgg

SEQ ID NO: 375371 - DNA, 490 bp, Homo sapiens
  misc_feature: GZ8MTXP02I0G14.51.82.H05.1.454.CMB.2.raw
  modified_base (206)..(206): a, c, t, g, unknown or other
  modified_base (320)..(320): a, c, t, g, unknown or other
  modified_base (382)..(382): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggaggatcctcttcttggtggcagcaaccacaggancccactcccaggtgcagctggtgcagtctgggactgaggtgagagctgggctcagtgaaggtctcctgcaagacttctggatacaccttcaccgactactatatgcactgggtnccgacaggcccctggacaagggcttgagtggatgggatggatcgacctaagaatggtgccanaaactatgcacagactttcagggctgggtcaccatcgaccagcgacacatctagcaacacagtctacatgagttgacctaagcctgacccgacacggccgtagtttag

SEQ ID NO: 375372 - DNA, 564 bp, Homo sapiens
  misc_feature: GZ8MTXP02H7DAT.51.82.H05.1.454.CMB.2.raw
  modified_base (220)..(220): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttgtggcagcaaccacaggagcccactcccaggtncagctggtgcagtctggggactgaggtgaagagcctggggcctcagtgaaggtctcctgcaagacttctggatacaccttcaccgtactactatatgcacgtgggtgcccgacacggcccctggacaagggcttgagtggagtggggatgggatccgaccctaaagatggtcgaccacaaactatgacacagtactttacgagggtcgtggggttaccaccgtagtacgaccgacggaccgaacacaactaccgtacgaccaaacactacggtacctaacgagtacggtagttcgaaccgaacgccgtacggaccgaccgtacccggtaccgtttagtttaagg

SEQ ID NO: 375373 - DNA, 511 bp, Homo sapiens
  misc_feature: GZ8MTXP02F6ZV0.51.82.H05.1.454.CMB.2.raw
  modified_base (325)..(325): a, c, t, g, unknown or other
  modified_base (390)..(390): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagcctggggcctcagtgaaggtctcctgcaagacttctggatacaccttcaccgactactatatgcactgggtnccgacaggcccctggacaagggcttgagtggatgggatgggatcgaccctaagaatggtgccaanaaactatgcacagactttcgagggtctgggtcaccatgaccagcgacacatactagacaaacacagtactacagtcggacgttgaaccaagccctacgaccgacgacggtccgtagtttag

SEQ ID NO: 375374 - DNA, 501 bp, Homo sapiens
  misc_feature: GZ8MTXP02JHJ7U.51.82.H05.1.454.CMB.2.raw
  modified_base (299)..(299): a, c, t, g, unknown or other
  modified_base (386)..(386): a, c, t, g, unknown or other
  modified_base (485)..(485): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgagagctggggcctcagtgaaggtctcctgcaagacttctggatacaccttnaccgactactatatgcacgtgggtgccgacacggccccctggacaaggggcttgagtggatgggatggatcgacctagatgtgcaanaactatgcacagtactttcgaggtctgggtccaccatcgacagcgacacatacagcaacacagtacaacatcggagttcgactaagcctacgaccgacnccggtaccgtgtttag

SEQ ID NO: 375375 - DNA, 533 bp, Homo sapiens
  misc_feature: GZ8MTXP02G2KQF.51.82.H05.1.454.CMB.2.raw
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaacagtcggggcaggttataatgtacactggtaccagcaactccaggaacacgcccccaaactcctacatccatgactaaccagaaactccggccccgtcggggtccccctgaccgtattcctctcggctccaagtctgacacttcacgtccctcctggcccatcactcgggacctccagactgaggtatggaggctagacttattacgtcgccctagtcctagtcgacagcaggtctgactgcgttggttcgggtttcggcggtacggaaccgagcgtcgaccgtcgtacggtcacg

SEQ ID NO: 375376 - DNA, 494 bp, Homo sapiens
  misc_feature: GZ8MTXP02HQAD7.51.82.H05.1.454.CMB.2.raw
  modified_base (327)..(327): a, c, t, g, unknown or other
  modified_base (382)..(382): a, c, t, g, unknown or other
  modified_base (385)..(385): a, c, t, g, unknown or other
  modified_base (390)..(390): a, c, t, g, unknown or other
  modified_base (395)..(395): a, c, t, g, unknown or other
  modified_base (479)..(479): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactgaggtgaagagccgtggggcctcagtgaaggtctcctgcaagcttctggatacaccttcaccgactactatatgcacgtgggtnccgacacggcccctggacaagggcttgagtggatgggatggatcgacctagatgncanaactntgcanagtactttgagggtctgggtcaccagtgaccagacgacacatcagacaacacgatctacagtgattcgacaagcctagaccganaccggcgttgtttag

SEQ ID NO: 375377 - DNA, 500 bp, Homo sapiens
  misc_feature: GZ8MTXP02IP319.51.82.H05.1.454.CMB.2.raw
  modified_base (259)..(259): a, c, t, g, unknown or other
  modified_base (270)..(270): a, c, t, g, unknown or other
  modified_base (376)..(376): a, c, t, g, unknown or other
  modified_base (380)..(380): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgagtgagagctgggctnagtgaaggtcnctgcaagacttctggatacaccttcaccgactactatatgcactgggtgccgacaggcccctggacaagggcttggagtggagtgggatggatcgacctaagatgngcanaaactatgcacagacttttcgagggtacgtcgggtcaccatacgaccagacgacacatactagacaacacagtctaacatggagttgaccaagacctgaccgacacggtccgtagtttag

SEQ ID NO: 375378 - DNA, 527 bp, Homo sapiens
  misc_feature: GZ8MTXP02HJDV3.51.82.H05.1.454.CMB.2.raw
  modified_base (209)..(209): a, c, t, g, unknown or other
  modified_base (223)..(223): a, c, t, g, unknown or other
  modified_base (447)..(447): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaaccacaggacncccactcccaggtncagctggtgcagtctgggactgaggtgaagagccgtggggcctcgagtgaaggtctcctgcaagacttctggatacaccttcaccgactactatatgcacgtgggtgccgacacgcccctggacagggcttgagtgatgggatggatcgacctaagaatgtgcaagaaactatgcacagtactttcgaggtctgggtcaccatagaccagcgaacacatcaaanacaacacatactactagtacggtacgttacgaacctaacgtaccgtacgaaccgaaccgtaccggtaccgtttagtttag

SEQ ID NO: 375379 - DNA, 683 bp, Homo sapiens
  misc_feature: GZ8MTXP02JHPLU.51.82.H05.1.454.CMB.2.raw
  modified_base (259)..(259): a, c, t, g, unknown or other
tcagcgatcgtatacacgaccggtgctcgatttagtcgagctctctcgcggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttanaatgtacactggtaccagcaacttccaggaacacgacccccaaaactcctcatccatgataccagaaactcccggcccgtcggggtccctcgaccgtacttctcgtcggctccgaagtcctcgactaccgttcacgtccctcccgtcggccctaacttccaccgtcggggcccttacccgagtaacccgttaggacgggaaacgttgggaacgggtccttacgggaaaccttaacgtttaacctccggtacccgtaaacggtttcccccttaaagttcggaaaccctaaggtcccgtaaacggggccttacgggaaaccttcgggtacccgtttagggtttcgggggtttttcccggggcccgggggtacccgggggtaacccgaaacgggtaccggttccggtaaccccggtttaaccccggg

SEQ ID NO: 375380 - DNA, 494 bp, Homo sapiens
  misc_feature: GZ8MTXP02HSHVL.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacccgccctcagtgtctggggccccagggcagagggtcaccatctcctgcactgggaacagttccaacatcggggcaggttataatgtacactggtaccagcaacttccaggaacagacccccaaactcctcatccatgataccagaaatcggaccctcgggggtccctgaccgattctctggcctcagtctgacacttcagcctccctgccatcactggctccagactgagatgaggctgactatactgccagtcctatgacagcagctgactgctgtcggtttcggcggtcggacaagctacgccgtctacgtcagcccg

SEQ ID NO: 375381 - DNA, 529 bp, Homo sapiens
  misc_feature: GZ8MTXP02FK1DA.51.82.H05.1.454.CMB.2.raw
  modified_base (352)..(352): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttcaggaacagcccccaaactcctcatccatgataccagaaactcggcccgtcgggggtccccctgaccgattcnctggctccaagtctgacacttcacgtcctccctggcccatcacgtggcctccagactgagatagaggctagactattactgaccagtacctatcgacgagcgaggcctagacctgccgttgttcggtttcggcggtacgggaaccgaacgtcgtcgaccgtcgtacggtccaaccgg

SEQ ID NO: 375382 - DNA, 526 bp, Homo sapiens
  misc_feature: GZ8MTXP02HLWY7.51.82.H05.1.454.CMB.2.raw
  modified_base (254)..(254): a, c, t, g, unknown or other
  modified_base (260)..(260): a, c, t, g, unknown or other
  modified_base (269)..(269): a, c, t, g, unknown or other
  modified_base (282)..(282): a, c, t, g, unknown or other
  modified_base (318)..(318): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgagagcngggctnagtgagtcnctgcaagacttcngatacaccttcaccgactactatatgcacgtgggtnccgacacggcccctggacagggcttgagtggagtgggatgggatccgaccgtaagagtggtagaccgaacaaactatgacacagtacgttttacgagggtcgtcgggtacaccagtacgaccgagacgacacactacgtagacaacacagtactacacgtacgagttacgaccaacgcctacgaccgacgacggtaccgttagtttag

SEQ ID NO: 375383 - DNA, 656 bp, Homo sapiens
  misc_feature: GZ8MTXP02IMFB7.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacagtcggggcaggttataatgtacactggtaccagcaacttccaggaacacgacccccaaactccctacatccatcgactaccaagaaactccggaccccgtccgggggtccccctcgaccgtacttcctcgtcggcctccgaagttctacgacctaccttcacgtccctcccgtggccctatcacgttcgggctcccgagactggacggtagtggacggtctacggtaacttattacgtacgaccctacgttacccttaagttacgaacgaacgcgaacgggtcttacggaccgttggttccgttcggggtttcgggggtttttacccggggccggggtacccgggggtaaacccgaaacgggtcccgttacgggtaacccccggttacccgttaaccggggtacccgaacccggg

SEQ ID NO: 375384 - DNA, 570 bp, Homo sapiens
  misc_feature: GZ8MTXP02HY3WI.51.82.H05.1.454.CMB.2.raw
  modified_base (331)..(331): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctggggactggaggtgaagagccgtggggcctcagtgaaggtctccgtgcaagacttcgtggatacaccttcaccgactactatatgcagtgggtnccgacgacggcccctggacagggcttgagtgatgggatggatccgacctaagagtggtcgaccaactaaactatcgaccaacgtacgttaacgttttcgaacgggtcgttaggggtaccaaccgtacgtacgaccgacggacgaacacactacgtaacgaccaacaccgagtacctaacacgtaggacgttacgacccgtaagaccgtacgacccgacgaccggtccgtttagtttacg

SEQ ID NO: 375385 - DNA, 579 bp, Homo sapiens
  misc_feature: GZ8MTXP02G4AGG.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagtccaacatcggggcaggttataatgtacactggtaccagcaacttccaggaacacgacccccaaactccctcatccatgactaccagaaatcggaccctcggggtccccctgaccgattctctcggctcccgaaagttctcgaaccacgttcagcccctccctggccctatcacttcgggctccagactgaggatgaggctagactattacgtgcctagtccctagtgaccagcgaacggcttcgactcggccgttggttcggggtttttcccggggcgggtaccggggtaacccgtaaggcccgttacgggtaaccccggtcccgttaacgggtacgaaacccggg

SEQ ID NO: 375386 - DNA, 530 bp, Homo sapiens
  misc_feature: GZ8MTXP02GZP3S.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctggggactgaggtgaagagcctggggcctcagtgaaggtctcctgcaagacttctggatacaccttcaccgactactatatgcacgtgggtgcccgacacggcccctggacaaggggcttggagtggagtgggatggatcgacctaagaatggtgccaacaaactatcgacaacagtacttttacgagggtctggggtacaccatcgaccgagcgacacatctagacaacacagtctaacatggaacgttcgaaccgaagcccgtacggacccgacgaccgggccgttagtttag

SEQ ID NO: 375387 - DNA, 523 bp, Homo sapiens
  misc_feature: GZ8MTXP02H7OWG.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaactccaggaacacgacccccaaactccctacatccatgataccagaaactccggcccgtcgggggtccccctgaccgattctctcggctccaagtctgacacttcacgccctccctggcccatcacgtgggcctccgagacgtgacggatggaggctgtacttattactgcctagtcctatcgacagcaggctgactgctggttcggtttcggcggcgggaacaggcgtcgaccgtccgtaggtcacg

SEQ ID NO: 375388 - DNA, 659 bp, Homo sapiens
  misc_feature: GZ8MTXP02JDJ7O.51.82.H05.1.454.CMB.2.raw
tcagcgatcgtatacacgaccggtgctcgatttagtcgagctctctcgcggggcgttcagctgtgggcacaagaggcagcactcaggacaatctccagcatggcctggtctcctctcctcctcactctcctcgctcactgcacagggtccctgggcccagtctgtactgacgcagccgccctcagtgtctggggccccagggcagaggtcaccatctcctagcactgggaacagttccaacagttcggggctaggttataatgtacactggtaccagcaacttccaggaacacgacccccaaatccctacatccgaattcgaactaccgaagtaaactccgggaccccttccgggggtaccccctcggacccgtattcctcgtcggcctccgaaaggtctacgaacctacgtttaccacgtcccttacccgtggcccaacttccgaacgttcgggcctcccgacgaaccgtgaaggtactaggaacggtcgttacggtacttaactttaaccgcgtacccgtaaaggttcccttaagtacgggaaccaacgtccgaagggtcttacggtacgtcggtcgttacggttcgggttttaccgggcgggtaccgggaaccgaacggccgtacggaacccgttccgtaacgggttccaaccggg

SEQ ID NO: 375389 - DNA, 559 bp, Homo sapiens
  misc_feature: GZ8MTXP02JXY4X.51.82.H05.1.454.CMB.2.raw
  modified_base (229)..(229): a, c, t, g, unknown or other
  modified_base (469)..(469): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctctgcactggaacngttccaacagtcggggcaggttataatgtacactggtaccagcaacttccaggaacacgacccccaaactcctacactccatgaactaccaagaaactccggaccccgtcgggggtccccctcgaccgtattcctcgtcggtcctccaaacggttcctagtaccactttaccaacgtcccctcccgtcggccctactccgacgtcgggcctccgagactgagtatggagctgactatacngccagtcctagcgacgagcgaggtctgactgtcgtgttcgggtttcggcggtccggaacgaacggtctacggaccgtcgtacggcaccgg

SEQ ID NO: 375390 - DNA, 619 bp, Homo sapiens
  misc_feature: GZ8MTXP02HR088.51.82.H05.1.454.CMB.2.raw
  modified_base (259)..(259): a, c, t, g, unknown or other
  modified_base (348)..(348): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctgggccccagggcagagggtcaccatctcctgcactgggaacagttccaacatcggggcaggttanaatgtacactggtacagcaacttccaggaacacgacccccaaatcctcactccatgataccagaaactcccggacccgtcggggtcccngaccgtacttctctgctccaagtcagactactcacgcctcccgtcgccactcaccgtggcctccagtacgtacgaggtatacggagggtctacggtacttactttaaccgtcggtaccctaacggttacccttaagtcgtaacccgaggaccgttaaacgggccttacggtaaccgttcgtcgtttcggtttcgggggtttttaacccgggccgggggtaacccggggtaacccgaacgggtccgttaccgggtacccggtttaaccccgg

SEQ ID NO: 375391 - DNA, 517 bp, Homo sapiens
  misc_feature: GZ8MTXP02JIZQI.51.82.H05.1.454.CMB.2.raw
  modified_base (387)..(387): a, c, t, g, unknown or other
  modified_base (450)..(450): a, c, t, g, unknown or other
  modified_base (473)..(473): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctgggccccagggcagagggtcaccatctcctgcactgggaacagttccaacagtcggggcaggttataatgtacactggtaccagcaacttccaaggaacacgacccccaaaatcctcactcccatgataccaagaaactccccggccccgtcgggggtcccctggaccgattctctggcctccaagtctgacncttcagccctccctgccatcacgtggcctccgagactgacggatggagctagacttagttacngccagtctaatcgacagcaggcngactgcgtgttcggttcggcggacggacagtctacgacgtaccg

SEQ ID NO: 375392 - DNA, 600 bp, Homo sapiens
  misc_feature: GZ8MTXP02H1LOR.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcaggagggtcaccatctcctgcactgggaacagttccaacagtcggggcaggttataatgtacactggtaccagacaacttccaaggaaccacgacccccaaactccctacactccatgactaaccagaaactccggacccgtcggggtcccctgacccgtattcctcgtggtcctccgaagttctacgacctacttcacgtccctcccgtgacccactcacgtcggtacctacccgagacctgagtatggaggtctagtaccttagttacgtcgccgtagtccttagtcgacgacgacgacggtctacgtacgtcgtcgttcgggtttcggtttaccgggcgggtaccggaaccgtacgtaccgtacggtacccgtaccggttacggtaccgacccgg

SEQ ID NO: 375393 - DNA, 491 bp, Homo sapiens
  misc_feature: GZ8MTXP02HGEG8.51.82.H05.1.454.CMB.2.raw
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctgggccccagggcagagggtcacatctcctgcactgggaacagttccaacatcggggcaggttataatgtacactggtaccagcaacttccaaggaacagcccccaaactcctacatccatgactaccagaaactccggccccgtacgggggtcccccctgaccgtattctctgctccaagtctgaccacttcacgccctccctgcccatcactggctcagactgagatgaggctgactatactgcagtctatgacagcagctagctgctgtgttcggcgcggaacagctcgacgtcagtcacg

SEQ ID NO: 375394 - DNA, 543 bp, Homo sapiens
  misc_feature: GZ8MTXP02GEVJG.51.82.H05.1.454.CMB.2.raw
  modified_base (374)..(374): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggcccccagggcagagggtcaccatctcctgcactgggaacagttccaacatcggggcaggttataatgtacactggtaccagcaacttccaggaaccacgacccccaaactcctcatccatgataccagaaactccggccctcggggtccccctgaccgtattctctggctccagtctgacncttcacgtccctccctgcccatccacgtgggcctccgagtactgacgatgagctgactatacgtgccagtcctatcgacagcgaggtcgtgacgtgtccgttggttcgggtttacgggccggtccgggaaccgtaaggtccgtacggtacccgtcgtacggtcaaccgg

SEQ ID NO: 375395 - DNA, 625 bp, Homo sapiens
  misc_feature: GZ8MTXP02JGPWD.51.82.H05.1.454.CMB.2.raw
  modified_base (291)..(291): a, c, t, g, unknown or other
  modified_base (332)..(332): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggacgcccactcccaggtgcagctggtgcagtcgtgggactgaggtagaagagccgtgggcctgagtgaaggtctctgcaagacttcgnggatacctaccttcaccgactactatatcgcacgtgggtcncccgacgacggcccctaggactaggggcttggagtggagtgggatggactccgtaaacccgtaagaagttcggacgaccaaacgtaaaactagtacggaacctaacgtaacgttaccgttttacggaacgggtcgtacggggttaccaaccgtagtaccgaccgacggaccgaacaactacttacgaacgaacaaaccacgtaacgtacctaaacgacggttaggtaacgttacgaaccgtaacgtcccgaacggaacccggaccgtaccgggtaccgtttaggtttttaagg

SEQ ID NO: 375396 - DNA, 509 bp, Homo sapiens
  misc_feature: GZ8MTXP02FZ4D3.51.82.H05.1.454.CMB.2.raw
  modified_base (444)..(444): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacacgacccccaaactcctcactccatcgataccagaaatcccggacccgtcggggtccctcgacccgattcctcgtcggctccaagtctgacacttcagccctccctggcccatccacgtgggcctccgagctgagatgagctgactattacngccagtcctaatgacagcaggctgactcgctgttcggtttcggcggtcggacagctcgaacgtcg

SEQ ID NO: 375397 - DNA, 555 bp, Homo sapiens
  misc_feature: GZ8MTXP02JKERZ.51.82.H05.1.454.CMB.2.raw
  modified_base (292)..(292): a, c, t, g, unknown or other
  modified_base (363)..(363): a, c, t, g, unknown or other
  modified_base (460)..(460): a, c, t, g, unknown or other
  modified_base (476)..(476): a, c, t, g, unknown or other
  modified_base (484)..(484): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtggggccccagggcaggagggtcaccatctcctgcacgtgggaacagttccaacagtcggggcaggttataatgtacactggtaccagcaactccaggaacncgacccccaaactcctcatccatgactaccagaaactccggacccgtcggggtccccctgaccgtacttcncgtcggctccaagtctgacctacttcacgtccctccctcggacccatccacgtcgggacctccgagacctggacggatggaggctgaactattacgngccagtcctatcgacngcaggtcngactcgcttggttcggtttcgggcggtacgggaaccaacggtcgtacggacccgtcgtacggaccaaccgg

SEQ ID NO: 375398 - DNA, 654 bp, Homo sapiens
  misc_feature: GZ8MTXP02HTUXQ.51.82.H05.1.454.CMB.2.raw
tcagcgatcgtatacacgaccggtgctcgatttagtcgagctctctcgcggggtcttcagctgtgggcacaagaggcagcactcaggacaatctccagcatggcctggtctcctctcctcctcactctcctcgctcactgcacagggtcctgggcccagtctgtactgacgcagccgcctcagtgtctgggccccagggcagaggtcaccatctctgcacgtgggaactagttaccaactagtcggggactaggttataatgtaacacgtaggtaccagacaacttccgaaggaaccacgacccccaaactcctacatccatacgactaaccagaaacgtccggaccgtccggggtcccctacgaccgtattccttcgtcggtacctcccgtaaagttcctacggaaccctaccgttcgaccgtccccctcccgtacggaccctaacgtcccgtacgtccgggtacccttacccggaagtaacgttacggaggtagtacgggtacggtacttacggtaactttacgttaacgtcgtacccgtacgttacctagtacgaacagacgaggttcagtacgtcgtcggtttcggttcgggtttaccggcggtacggggaacctaggcgttaccggaccgttacgtacggtaccaccgg

SEQ ID NO: 375399 - DNA, 726 bp, Homo sapiens
  misc_feature: GZ8MTXP02GB8X2.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggaacagttccaacagtcggggcaggttataatgtacactggtaccagcaacttccaaggaaccacgacccccaaactccacactccatcgaactaccaagtaaactccccggtacccgtccgggggtaccctacggacccgtactttccgtccgtcgggtacctaccgtaaacgttcctacgtaaccctacctttaccgaccgtcccccttcccgtaccggaccctaacgtcccgtaaccggtcggggtacccttacccgaacggtaccttaggggaacgggtagtacgggacgggtaccgttacggtaaaccttaacgtttacccgtacggtaccccgttaaacggttccctaacgttacggaaccgtaacggccgtaagggtcgttacggtaaccggttcggtccggtttggggtttccggggttttcccggggaccgggggtaccgggaacccgtaacggtcccggttaccggaaccccggtttacccgg

SEQ ID NO: 375400 - DNA, 649 bp, Homo sapiens
  misc_feature: GZ8MTXP02G9P0J.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgcctcagtgtcgtgggccccagggcaggaggtcaccatctcctgcacgtagggaactacgttccaacgagtcggggactaggttaataagtgtaacacgtacggtaccagacctaactccgaaggaaccaccgacccccaaactcctacactccgaatcgaactaaccaagaaacgtccggccccggtaccggggtcccctacgaccgtattctcgtcggactaccgaagtctacgacctacttcgaccgtccccttccgcggaccctatccgacgttcgggaccaccgaagacgtagagagttacggaggtcctacggtaacttaagttccgtcgacctacggtccttaagacgacgacgacgacgacgtacgtacgtcgtccgttggttcgggtttccggggtaccgggaccgggaaccggaaacgtccggtaccggtacccggtaccggttaccggtaccgtaaccccgg

SEQ ID NO: 375401 - DNA, 559 bp, Homo sapiens
  misc_feature: GZ8MTXP02HRDS6.51.82.H05.1.454.CMB.2.raw
  modified_base (207)..(207): a, c, t, g, unknown or other
  modified_base (221)..(221): a, c, t, g, unknown or other
  modified_base (229)..(229): a, c, t, g, unknown or other
  modified_base (256)..(256): a, c, t, g, unknown or other
  modified_base (337)..(337): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggancccactcccaggtncagctggncagtctgggactgaggtgaagagccgnggggcctcgagtgaaggtctcctgaccaagtacttctggataccaccttcaaccgacttactatatgactacgtggggtcnccgacacggcccctaggacaaggtcttggagtggatgggatggactacgacctaagaagtggtacgaccaaactaaaacgtatcgacaacgtagttaccgttttacgaggggtactggggttaccaacgtagtacgaccgagacgactacatctagacaacactagcctagagtcgagttacgacaaggtccaaggaccgaactcggtaccgttagttttag

SEQ ID NO: 375402 - DNA, 526 bp, Homo sapiens
  misc_feature: GZ8MTXP02G0UDV.51.82.H05.1.454.CMB.2.raw
  modified_base (333)..(333): a, c, t, g, unknown or other
  modified_base (377)..(377): a, c, t, g, unknown or other
  modified_base (397)..(397): a, c, t, g, unknown or other
  modified_base (401)..(401): a, c, t, g, unknown or other
  modified_base (411)..(411): a, c, t, g, unknown or other
  modified_base (423)..(423): a, c, t, g, unknown or other
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccactcctgcactggaacagttccaacatcgggcaggttataatgtacactgtaccagcaactccagaacacgcccccaaactcctcactccatgataccagaaataccgccctcggggtccncgaccgattctctgctccagtctgcactctacgctccctgccancactggctccagctgagagngagntgactatacncgccacgtctangacagacgagtctagtacgttgtcgtttcggttcggggtttaccggggcggcgggtaaccgaaggtccgtacggtacccgtccgtaacggtccgacgtacccg

SEQ ID NO: 375403 - DNA, 548 bp, Homo sapiens
  misc_feature: GZ8MTXP02G5I8O.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagccgtggggcctcgagtgaaggtctcctgacaagcttctggatacaccttcaccgactactatatgcacgtgggtcgccgacgacggccccctaggaacgaaggggcttggagtggagtgggatggataccgaccctaaagaaagtggtcgaccaacgaaactatagacaacgagtacttttacgacgggtcgtgggtaccaccgagtacgaaccagacgacacatcaagacaacacagtctacataggacgttcgacgaacgcgtacgaccgaccgacggtccgttagtttacg

SEQ ID NO: 375404 - DNA, 617 bp, Homo sapiens
  misc_feature: GZ8MTXP02HHA9X.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggaacagttccaacagtcggggcaggttataatgtacactggtaccagcaacttccaggaacacgacccccaaactccacactccatgactaaccagaaactccccggccccgtccggggtaccctcgaccgtacttcgtcgtcgggacctaccgaagttcctacgacctaccttaccacgcccttcccgtcggacccaacgttccgaccgttcgggccctacccgacgaccgttaggaacgggtatacgggaagggtcctagtaaccttattaccgtcggcctacggttcctaatacgacgaacgtccgagcgtacgtcgtcgtcgttggtttcgggtttcggcggggaccggaccgtacggtccgtaccggtaccgttaccgg

SEQ ID NO: 375405 - DNA, 625 bp, Homo sapiens
  misc_feature: GZ8MTXP02H78WS.51.82.H05.1.454.CMB.2.raw
  modified_base (175)..(175): a, c, t, g, unknown or other
  modified_base (182)..(182): a, c, t, g, unknown or other
  modified_base (187)..(187): a, c, t, g, unknown or other
  modified_base (357)..(357): a, c, t, g, unknown or other
tcagcgatcgtatacacgaccggtgctcgatttagtcgagctctctcgcggggctctgcttcagctgtgggcacaagaggcagcactcaggacaatctccagcatggcctggtctcctctcctcctcactctcctcgctcactgcacagggtcctgggcccagtctgtactgacncagcccnccctnagtgtctggggccccagggcagaggtcaccatctcctgccactgggaacagtccaacagtcgggcaggttataatgtacactggtaccagcaaacttccaggaaccacgacccccaaactccctacactccatgactaaccagaaactccccggcccgtccggggtcccncgtaccgtacttcctcgtcggtcctaccgtaacgtctcgactaccttccacgccctccctcgacccactcgtacgtcgggccctaccgacgtaacctggaggtaacgtggaacggtcgttacggaactttaacgttaaccgtcggtacccgacgttaccctagtacggaaccaacgcggtacggccttaggaccttgtccgtttcggttacggttttccgggccgggtaccggggtaccaaacggtccgtaccggtaacccgtcccgg

SEQ ID NO: 375406 - DNA, 611 bp, Homo sapiens
  misc_feature: GZ8MTXP02HSRFV.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcaggagggtcaccatctcctgcacgtgggaacagttcccaacagtcggggcaggttataatgtacactggtaccagcaacttccaggaaccacgacccccaaaactcctacactccaatgaactaacccaagaaaacgtcccccgggaccccgttccgggggtcccctggacccgtatttcctcgtacggcctaccaacgtctacgactaccttcacgtccctccctcgccatcacgtcggctaccagactaggaggagtggagcgtacgtaacttattaccgtcgaccgtacgttaccctagtacgaacgagcgacgggtcctaggactcggtcgttcgggtttcgggttttaaccggggcggggtaccgggacccgaaggtccgtacggtacccgttaccgg

SEQ ID NO: 375407 - DNA, 608 bp, Homo sapiens
  misc_feature: GZ8MTXP02HKN0X.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcactgggaacagttccaacagtcggggcaggttataatgtacactggtaccagcaacttccaaggaacacgcccccaaatccctacactccatgactaccagaaactccggcccgtcggggtccccctgaccgtattcctcgtcggcctccgaagttctacgacctaccttcacgtccctcccgtggaccctatcacgttcggggacccttacccgagtaccgtggaacggagttcggaacgggtctaggtaaccttaagttaccgtcgaccctaagtccctaagtcgaacgagcgacggtctacggtactcggtcgttggttcgggtttcgggccgggtaccgggaaccgaaggtccgtcggaccccgtcgtacggtaccaccgg

SEQ ID NO: 375408 - DNA, 527 bp, Homo sapiens
  misc_feature: GZ8MTXP02H4BJO.51.82.H05.1.454.CMB.2.raw
  modified_base (206)..(206): a, c, t, g, unknown or other
  modified_base (220)..(220): a, c, t, g, unknown or other
  modified_base (229)..(229): a, c, t, g, unknown or other
  modified_base (328)..(328): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggancccactcccaggtncagctggtncagtctgggactgaggtgaagagccgtggggcctgagtgaaggtctcctgcaagacttctggataccaccttcaccgtactactatatgcacgtgggtnccgacacggcccctggacagggcttggagtgagtgggatggatcgacctaagatggtgaccaactaaactatgacacagtactttacgagggtctgggtcaccgagtacgacagacgacactactacagacaaacactagtactacagttgacgttacgacctaagccgtacgaccgtacgaccggtccgttagtttag

SEQ ID NO: 375409 - DNA, 507 bp, Homo sapiens
  misc_feature: GZ8MTXP02F85DI.51.82.H05.1.454.CMB.2.raw
  modified_base (327)..(327): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcgagtgaaggtctcctgcaagacttctggatacaccttcaccgactactatatgcactgggtnccgacaggcccctggacaagggcttgagtggatgggatggatcgacctaagaatggtgcacaaactatgcacagtactttacgagggctgggtcaccatagaccagcgacacatactagcaacacagtactacagtggaacgttgaccaagcctagaccgacgacggccgttagtttacg

SEQ ID NO: 375410 - DNA, 622 bp, Homo sapiens
  misc_feature: GZ8MTXP02G4W62.51.82.H05.1.454.CMB.2.raw
  modified_base (434)..(434): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtcgtcgtcggggccccagggcagagggtcaccatctcctgcacgtgggaacaggttccaacgagtcggggacaggttataagtgtacatggtaccagcaacttccaaggaacacgacccccaaatcctcatccatgaactaccaagaaacgtccccggccccgtcggggtcccacggaccgtacttcctcgtcggcctaccgaagtcgtacgacctacgttccacgtccctcctcggcctatccncgtacggcctaccgacgtacgtcggaaggatggacggtactacggtaaccttaacgttaccgtcgtaccctacggtcccttaagtcgaaccgtaagcccgtaggtccttacggaccttcggtccgttggggtttcggtttcggggacggacccggggtaacaacggggtctaccgggaccgttacccg

SEQ ID NO: 375411 - DNA, 738 bp, Homo sapiens
  misc_feature: GZ8MTXP02HHIPK.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtcggggccccagggcaggacggtccaccatcctctgcacgtgggaactacgttccaacgagtcgggctaaggttataatgtacacgtaggtaccagactaacctcgaaggaaccaccgaccccctaaactcctacactacccgaatacgaactaaccgaacgaaaacgtcccggtaccccggttccgggggtacccccctacggaccgtactttcctcgtaccggtcctaccgaaacgttctacgtacctaccgttccgaccgtccccgtcccgttcggaccctaacgtaccgtaccgtcgggtccctaccgaacgtacgttacgggtacggagtacgggacggtacttacgtaacttactttaccgacgtaccctacggtaccttaacgtcgaaaccgtaacgccgaaccggtacgtacggtaccgttggttccggtttcggggtttaaccggggttttccgggggacccggggttaccggggaacccgaacgggttcccggttaccggtaacccgggttcccggtaaacggttcccggaaccccggg

SEQ ID NO: 375412 - DNA, 542 bp, Homo sapiens
  misc_feature: GZ8MTXP02GJ4DT.51.82.H05.1.454.CMB.2.raw
  modified_base (207)..(207): a, c, t, g, unknown or other
  modified_base (389)..(389): a, c, t, g, unknown or other
  modified_base (401)..(401): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggancccactcccaggtgcagctggtgcagtctgggactgaggtgaagagcctggggcctcgagtgaaggtctcctgacaagacttctggatacaccttcaccgactactatatgcacgtgggtgccgacacggcccctggacaagggcttgagtggagtgggatggatacgacctaagagtggtnaccaagaaactntgacacagtactttcgagggtcgtgggtaccactagtcgaaccgagacgacacgtatacgtaacgacaaacactacgtctaaacacgtggtaacgttcgaacctaagcccgtacgaccgtacgacggtccgttagtttacg

SEQ ID NO: 375413 - DNA, 543 bp, Homo sapiens
  misc_feature: GZ8MTXP02IQLHI.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagagggtcaccatctcctgcactgggaacagttccaacagtcggggcaggttataatgtacactggtaccagcaacttccaggaaccacgacccccaaatccacatccatcgactaccagaaactcccggccccgtcggggtccctgaccgtacttctcgtggctaccgaagtcctgacctacttcacgccctccgtcgccactcacgtcggcctccgagacgtgagactaggagctgactattacgcgcagtcctagtcacgacgcgaggtctacgacgtcgtcttggttcggtttcgggcggtacgggacctaaggtccgtacgtacccgtacgg

SEQ ID NO: 375414 - DNA, 539 bp, Homo sapiens
  misc_feature: GZ8MTXP02GW20A.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctggggactgaggtgaagagccgtggggcctcgagtgaaggtctcctgcaagacttctggactacaccttcaccgactactatatgcacgtgggtgccgacacgcccctggacaagggcttgagtggagtgggatggatcgacctaagaatggtgacaacaaactagtgacacagtactttacgagggtcgtgggtacaccgtagtcgaacccaggaccgaacacatacagaccaaacacagtactaacgtagtcggagttacgaccaagcccgtagacccgacgaccggtccgttagtttaacg

SEQ ID NO: 375415 - DNA, 522 bp, Homo sapiens
  misc_feature: GZ8MTXP02GSC7L.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacagtcggggcaggttataatgtacactggtaccagcaacttccaggaacacgcccccaaactcctacatccatgactaccagaaactccggcccgtcggggtccccctgaccgtattctctggctccaagtctgactacttcacgtccctccctgccatcactcggctccagactgacgatgagctgactatactgccagtctatcgacagcagctgactgtcgttggttcggtttcggcggtacggaacgaacgtcgtacggaccgtcgtacggtcgaaccg

SEQ ID NO: 375416 - DNA, 638 bp, Homo sapiens
  misc_feature: GZ8MTXP02JE24T.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggaacagttccaacagtcggggcaggttataatgtacactggtaccagcaacttccagaacacgaccccaaactcctacactccatcgaactaccaagtaaactccccgcccgtccgggggtaccctcggacccgtacttctcgtcgggcctaccgaacgtctacgtacctacttccacgtcccctccctcggacctacgtacaccgtcggggcctcccgagaccgttggaacggtagtacggacggccttacggtaaccttaacgttaccgttacggaccctacggttacctactacgaaccgacggcgtaagggcctacggtacgtcggtccgttggtttacggggtttcccgggccggggtaccgggtacccgaacggtccgttacggacccggtttacccgg

SEQ ID NO: 375417 - DNA, 598 bp, Homo sapiens
  misc_feature: GZ8MTXP02HVPE7.51.82.H05.1.454.CMB.2.raw
  modified_base (220)..(220): a, c, t, g, unknown or other
  modified_base (314)..(314): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttctggtggcagcaaccacaggagcccactcccaggtncagctggtgcagtctgggactgaggtgaagagccgtgggcctgagtgaaggtctcctgacaagcttctggactacaccttcaccgactactatntgctacgtggtcgccgacaccggcccctaggacgaagggtcttggagtggagtgggagtggactaccgaacctaaagagttggcgacaactaaaatcgtagacaacgtagtacttttaccggaggggtaccttaggggttacccaaccgtagtaccgaaccacggaccaacactactacgtaacgaccaaaacactacgtacctaaacgtacgtaggtacgttacgaacccgaacggtccgttaaccggaacccggacgaacccggttccgtttacgttttagg

SEQ ID NO: 375418 - DNA, 584 bp, Homo sapiens
  misc_feature: GZ8MTXP02GD3BL.51.82.H05.1.454.CMB.2.raw
  modified_base (237)..(237): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtcnggggactgaggtgaagaagccgtggggcctgagtgaaggtctcctgcaagtcttctggataccaccttcaccgtactactatatgcacgtgggtcgccgacgcggcccctgggacaacggggtcttggagtgggatggggatgggatccgaaaccctaagaagtgggtacgaccgaacaaactatagccaactagtactttcggagggtcgtcgggtaccaccgagtcggaaccacggacgacaacctatactaacgacctaaacacgtagtacctaacgacgtaggtaacgttaccgaaccgaacgtccgtacgacccgaacgtacgggtccgtttagttttacgg

SEQ ID NO: 375419 - DNA, 643 bp, Homo sapiens
  misc_feature: GZ8MTXP02IB5QS.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctcggggccccagggcagagggtcaccatctcctgcactgggaacagttccaacagtcggggcaggttataatgtacactggtaccagcaacttccaggaacacgacccccaaactcctcactccatgaactaccaagaaactccccggaccccgtccgggggtccctcgaccgtattcctcgtcggtcctaccgtaacgttcctagacctaccttccacgcccctcccgtcggacccactaccgaccgtcgggcctaccgacgacgtaggacggtagtacgggacggtctaggtaaccttaacgttaaccgtcgtacctaacggttccctaagtacgaccgtaagtcgaacgggtctacggaacgttcgtaccgtttggtttcggggttttccggggccggggtaccgggtaaccggtaacgtccggttaccggtacccggtttacccgg

SEQ ID NO: 375420 - DNA, 589 bp, Homo sapiens
  misc_feature: GZ8MTXP02I28EC.51.82.H05.1.454.CMB.2.raw
  modified_base (181)..(181): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctnttctggtggcagcaaccacaggacgcccactcccaggtgcagctggtgcagtcgtgggactggaggtgaagagcgtggggcctcgagtgaaggtctccgtgacaagacttgtaggactaccaccttcaccgactactatatcgctacgtggtcgaccgtacgacggccccgtaggacaacgggcttggagtggagtgggactgggactacgaacccgtaagtaagtggtacgaccaaacgtaaactacgtacgactaacgtagtacgttttacgaagggtcgtacgggtacacctacgtacgaacccgagaccgaacactacgtactaacgacaacgactagtactaacacgtaggtacgttcgaccgaacgaccgtacgacccgacgaccggtcgttacgttttagg

SEQ ID NO: 375421 - DNA, 706 bp, Homo sapiens
  misc_feature: GZ8MTXP02HEMDB.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtcggggccccagggcagagggtcaccatctcctgcacgtgggaaccagttccaacagtcggggactaggttataatgtacacgtcggtaccagacaacttccaggaaaccacgacccccaaaactccacactccatacgaactaaccaagtaaacgtccccggaccccgtcggggtccctcgaccggtacttcgtccgtcggtcctaccgaagtccttacgacctacctttaccacggtcccccttcccgtcggaccctaacgttcccgaaccgttcggggcccttacccgacgtaaccgttggaaggtacgttggaacgggtcgtacggtaacctttaactacgttcgacccgtacggttaccctaagttacgaacccggtacggtacgacggtaccgtacggtaccgttacgggttccgtttcggggtttaccggggtttaacccggggcccggggttacccgggtaacccggtaaccgggtaccggttacccggtaacccggttaccgg

SEQ ID NO: 375422 - DNA, 660 bp, Homo sapiens
  misc_feature: GZ8MTXP02F0YPR.51.82.H05.1.454.CMB.2.raw
  modified_base (231)..(231): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggacgcccactcccaggtcgcagctggtnctagtcgtggggactggaggtgaagaacgccgtggggcctgagtgaaggtctcctgacaagtacttcgtggactaccgaccttcaccgtacttactatattcgctacgtggggtcgaccgtacaccgggtcccctaggacgaaggggtcttggacgtggagtgggatggactccgaaccgtaagaagttgggacaccaaacgtaaactcgtacgaactaacgtaagttaccgttttacggacgggtacgttacggggtaccctaacgtagtaccgaacccgagaccgaactaacgactacgtaaacgaccaaaactacgtaacggttaccttaaacgtaaggttacggtaacgttaccgaaaccgtaaccggtacccgttaacgggaaccccgtaacggtaacccgggttccggtttagtttttaacgg

SEQ ID NO: 375423 - DNA, 550 bp, Homo sapiens
  misc_feature: GZ8MTXP02F339Z.51.82.H05.1.454.CMB.2.raw
  modified_base (404)..(404): a, c, t, g, unknown or other
  modified_base (410)..(410): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggagcccactcccaggtgcagctggtgcagtctggggactgaggtgaagagcgtgggctcagtgaaggtctcctgcaagtacttctggatacaccttacaccgtactactatatcgcacgtgggtcgccgacgacggcccctaggacaagggcttggagtggagtgggatggatccgaaacctaagaagtggtacaccgaanaaactntagacacagtactttcgaggtcgtggtcaccagtcgaacgagacgaacacatacacgacaaacacagtactaacagttagtacgttacaaccgaagtacccgacgaccccggacgtaccggtaccggtttacgtttaagg

SEQ ID NO: 375424 - DNA, 670 bp, Homo sapiens
  misc_feature: GZ8MTXP02G1Q7V.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctcggggccccagggcagagggtcaccatctcctgcacgtgggaacagttccaacgagtcggggacaggttataatgtacactggaccagacaacttaccaggaaccacgacccccaaactccacactccatcgaactaccaagaaactccggcccgtcggggtccccctcgaccgtattccgtcgtcggcctaccgaagtctacgacctacgttccacgtccccttcccgtcgcccactccacgttcgggccttaccgacgtaccgtaggaggtagttaggacggtacgtacggtaacttaacgtttaccgtacgtaccctaaacgttcccttaatcggaaccgacggacgaacgggtccttacggtaccgttcggttccggtttggggtttccgggttttcccgggggaccggttacccggggaaccgtaacggtccgttaccgggtaacccgttccggtacgggtaccgtaaaccccggg

SEQ ID NO: 375425 - DNA, 559 bp, Homo sapiens
  misc_feature: GZ8MTXP02HVM5Y.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcactgggaacagttccaacagtcggggcaggttataatgtacactggaccagcaactccaggaacacgcccccaaactcctcatcccatgataccagaaactccggacccgtccggggtccccctgacccgtattcctctcggctccaagtctgacctacttcacgtccctccctgcccatcacgtcgggcctccgagactggacgagtggaggtctagtactattacgtcgacctagtccctatcgacagcaggctgactgtcgttggttcgggtttccgggcggtaccgggaaccgaacggccgtacggacccggttccgtaacggtccaaccgg

SEQ ID NO: 375426 - DNA, 628 bp, Homo sapiens
  misc_feature: GZ8MTXP02J1RF5.51.82.H05.1.454.CMB.2.raw
  modified_base (99)..(99): a, c, t, g, unknown or other
  modified_base (334)..(334): a, c, t, g, unknown or other
tcagcgatcgtatacacgaccggtgctcgatttagtcgagctctctcgcgggcacgaccggtgctcgatttagtcgagctctcagagagaaagggggancatcacccagcaaccacatctgtcctctagagaatcccctgagagctccgttcctcaccatggactggacctggaggatcctcttcttggtggcagcaaccacaggacgcccactcccaggtgcagctggtgcagtctgggactgaggtgaagagcgtggggcctcagtgaaggtctcctgacaagtcttcgtggactaccaccttcaccgacttactatatcgactagtgggtncccgacgcggcccctaggacgaaggtcttggagtggagtgggatgggactccgaaacccgttaaaggaagtcgggtacgaaccctaaacaaacgttacgacgaccctaacgtaacgtttaccgttttacgggaacgggggttcgttacgggggtacctaaccgaacgttaccggaaccgacggaccgaactaactacgttaccgtaacgacctaaaccacgtaacgtactaacgaggtacggtacgtacgaccgcgtccgtacggacccgaccgacggtaccgttagttttaag

SEQ ID NO: 375427 - DNA, 591 bp, Homo sapiens
  misc_feature: GZ8MTXP02GZX3N.51.82.H05.1.454.CMB.2.raw
  modified_base (265)..(265): a, c, t, g, unknown or other
  modified_base (367)..(367): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcctggggcccccagggcagagggtcaccatctcctgcacgtgggaacagttccaacagtcggggctaggttanaatcgtacacgtaggtaccagcaacttccaaggaaccacgacccccaaaactcctacactcccatcgaactaccaagaactcccggccccgtcggggtcccncgaccgattctcgtggctaccgaagtcctagactaccttcacgtccctcccgtcgccctatcctaccgtcgggtacctaccgagacctaggacggagtcggaaggcttaggtaactacttactcggtaccacgttcctaagtcgaacgacgtacgaggtctacgtcgtcgtaccgtggttcggtttaacggcggtacggaccagtccgtacgtacccgttacgg

SEQ ID NO: 375428 - DNA, 583 bp, Homo sapiens
  misc_feature: GZ8MTXP02J076D.51.82.H05.1.454.CMB.2.raw
  modified_base (339)..(339): a, c, t, g, unknown or other
  modified_base (428)..(428): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggactcctcttcgttggtggcagccaaccacaggacgcccactcccaggtgcagctggtgcagtcgtgggactgaggtgaagacgcgtgggcctgagtgaaggtctcgtgacaagtacttcgtaggactacaccttacaccgactactatatgctacgtgggtcncccgacgacggccccgtaggacgaagggtcttggaggtggagtgggatggactccggaacctaaagaagtggtacaccgaaactaactntacgactacgtacgttacgtttacggagggtcgtagggtaccacacgtacgaccgacgaccgacactagtacagaccaactacacgtacaactacgtaggtacgtacgacctaacgccgtacggacccgtacggtcggtaccgtttagttttacg

SEQ ID NO: 375429 - DNA, 590 bp, Homo sapiens
  misc_feature: GZ8MTXP02IBB69.51.82.H05.1.454.CMB.2.raw
  modified_base (206)..(206): a, c, t, g, unknown or other
  modified_base (220)..(220): a, c, t, g, unknown or other
  modified_base (229)..(229): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggaggatcctcttcttggtggcagcaaccacaggancccactcccaggtncagctggtncagtctgggactgaggtgaagagctgggctcagtgaagtctctgcaagacttgtgatacaccttcaccgactactatatgcacgtggtgccgacgacggcccctggacaagggcttgagtggagtgggatggatacgaccctaagaatggtgacccaactaaaacgtatagacaacgtacgtacttttacgacgggttacgtagggttaccaccgtactacgaccaacggcgaactaactactacgtaaacgccaaaaccgactaaggttaccttaaccgaaagttacggggaacgtttcgaaccgtaacgacccgtacggaacccgaaccgtacccgggtacccggtttagttttaacgg

SEQ ID NO: 375430 - DNA, 557 bp, Homo sapiens
  misc_feature: GZ8MTXP02HLNFV.51.82.H05.1.454.CMB.2.raw
  modified_base (182)..(182): a, c, t, g, unknown or other
  modified_base (209)..(209): a, c, t, g, unknown or other
  modified_base (225)..(225): a, c, t, g, unknown or other
  modified_base (234)..(234): a, c, t, g, unknown or other
  modified_base (295)..(295): a, c, t, g, unknown or other
  modified_base (337)..(337): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctnttcttggtggcagcaaccacagggacnccccactcccagggtncagctggtncagtctggggactgaggtgaagagccgtggggcctcgagtgaagtctcctgcaagtcttgnggataccaccttcaaccgtactactatatgctacgtggggtncccgacgacggcccctagggacagggtcttggagtaggagtgggatggactcgaaccgtaagacgtgtcgactaacaactatgacacagtactttgacggtcgtcgggtacacgtacgtagaccgagacgaacactactcgacgacaaacactacgtactacgagtaggtacgttaccgacgtaacgcgtacgaccgacgtccggtaccgtttgtttacg

SEQ ID NO: 375431 - DNA, 546 bp, Homo sapiens
  misc_feature: GZ8MTXP02I5B9E.51.82.H05.1.454.CMB.2.raw
  modified_base (326)..(326): a, c, t, g, unknown or other
  modified_base (399)..(399): a, c, t, g, unknown or other
  modified_base (405)..(405): a, c, t, g, unknown or other
  modified_base (487)..(487): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagccgtgggcctcagtgaaggtctctgcaagacttctggatacaccttcaccgactactatatgcacgtgggtcnccgacgacggccccgtaggacaaggtcttggagtggagtgggatggatccgaacctaagaatggtagaccaanaaactntagacaacgagtactttacgagggtcgtacgggtccaccatacgaccagacgacacgatacgtagacaacacagtacctaanacgtaggtacgttcgaccgaacgccgtacggaacccgacgaccggtccgttagttttag

SEQ ID NO: 375432 - DNA, 506 bp, Homo sapiens
  misc_feature: GZ8MTXP02INMHY.51.82.H05.1.454.CMB.2.raw
  modified_base (180)..(180): a, c, t, g, unknown or other
  modified_base (205)..(205): a, c, t, g, unknown or other
  modified_base (228)..(228): a, c, t, g, unknown or other
  modified_base (322)..(322): a, c, t, g, unknown or other
  modified_base (380)..(380): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (395)..(395): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggagatcctnttcttggtggcagcaaccacaggancccactcccaggtgcagctggtncagtctgggactgaggtgaagaagcctggggctcagtgaaggtctctgcaagacttctggatacaccttcaccgactactatatgcactgggtnccgacacggccccctggacaagggcttggagtggatggatgggatcgacctaagatgncanaaactntnacanagtactttagaggtctgggtcaccgatacgaccagcgacacatcaagcaaacacagtcctagacgtaggtaactgaccaagtcccagaccgacgaccggtcgtacgtttag

SEQ ID NO: 375433 - DNA, 728 bp, Homo sapiens
  misc_feature: GZ8MTXP02H3US4.51.82.H05.1.454.CMB.2.raw
  modified_base (240)..(240): a, c, t, g, unknown or other
  modified_base (256)..(256): a, c, t, g, unknown or other
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctctgcacgtgggaacagttccaacngtcggggacaggttanaatgtacactggtaccagacaacttccaaggaaccacgaccccccaaactccctacactccaatgaactaaccaagaaaacgtccgggaccccgtcgggggtcccccctacgacccgtattccgtcgtcggtcctcctaaacgttctacgtacctaccttaccgacgtcccctcccccgtaggccctaactccgtaaccgtcgggggtacccttacccgaacgtacccgtacgggtaggtaacgttcgggaaacgggtcttacggttaaaccttaacgttaaccgtccggtacctaaacggttacccttaagtacgtaaacccgtagtcccgaaagggtcctaaggtaccgttacggtaccggttacgggtttacgggggtttacccgggccgggggttacccggggtaaacccgaaacgggtccggttaccggacccggtttacccgtaaacggggttcccgtaacccggg

SEQ ID NO: 375434 - DNA, 596 bp, Homo sapiens
  misc_feature: GZ8MTXP02GY8Q1.51.82.H05.1.454.CMB.2.raw
  modified_base (357)..(357): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactggaggtgaagaagccgtggggcctcaggtgaaggtctccgtgacaagtacttcgtaggactaacctacccgtttacaacccgtactaaccttaatagtcgactacgtggggtacncccggacgaccggacccctaggacgaagggtcttggagtggagttgggatggactaccgtaacctaagaagtggacgaccaaacaaactactagacaacgtagtactttacggaggtcgtcgggtacaccgtagtacgaaccgagaccgaacactattaccgaagacaaaactacgagttaccagacgttaggactacgaccaagccgtacgaccgacgtaccggtcgttagttttacg

SEQ ID NO: 375435 - DNA, 574 bp, Homo sapiens
  misc_feature: GZ8MTXP02IDG6E.51.82.H05.1.454.CMB.2.raw
  modified_base (225)..(225): a, c, t, g, unknown or other
  modified_base (442)..(442): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcaggagggtcaccactctcctgnacccccccccgtgggaacagttaccaacatcgggcaggttataatgtacactggtaccagcaacttccaggaacacgaccccaaactcctcactccatgactaccagaaactcgcccgtcggggtcccctcgaccgattctctcggctccagtctgacactcacgcctccctgccctatcacgtggctcagctgacgatggagtctagactattacncgacctagtccgtatcggacacgacgacgggtcttcggactcgtccgttggtttcgggttttcgggccggtaccggggtaaccgaaacggcccgttacggaaccccgttccgtaacggttccgaaacccggg

SEQ ID NO: 375436 - DNA, 581 bp, Homo sapiens
  misc_feature: GZ8MTXP02JGGNQ.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagaggtcaccatctcctgcacgtgggaacagttccaacagtcggggcaggttataatgtacactggtaccagcaacttccaggaacacgacccccaaaatccctacactccatcgaactaccaagtaaacgtccccggacccgtcggggtccctaggaccgtacttctcgtcggctaccaagtctacgacctacttcacgtccctcccgtcgccactcacgtcggcctccagacgtaggacgagtgacggctacggtaacttacgttacgtcgacctacgtcctagtcgaaccgagcgacgctacgactcgtcgttggtttacgggtttccggccgggtacggaccgtaacggccgttacggtaacccggttccg

SEQ ID NO: 375437 - DNA, 539 bp, Homo sapiens
  misc_feature: GZ8MTXP02JT0EO.51.82.H05.1.454.CMB.2.raw
  modified_base (263)..(263): a, c, t, g, unknown or other
  modified_base (396)..(396): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactgaggtgaagagctgggcctnagtgagtctctgcagctctggatacaccttcaccgactactatatgcacgtgggtgccgacacggcccctggacaagggtcttggagtggagtgggatggatcgacctaaagagtggtcgaccaacaaactanacgacacagtactttcgaggtcgtcgggtcaccgagtacgaccgacgacgacacatactagaccaaacacgtagtactaacagtacggtacgttacgaccaacgacccgtacgacccgacgaccgggtccgttaggttttacg

SEQ ID NO: 375438 - DNA, 598 bp, Homo sapiens
  misc_feature: GZ8MTXP02ICXA7.51.82.H05.1.454.CMB.2.raw
  modified_base (230)..(230): a, c, t, g, unknown or other
  modified_base (262)..(262): a, c, t, g, unknown or other
  modified_base (499)..(499): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggaggatcctcttcttggtggcagcaaccacaggacgcccactcccaggtgcagctggtncagtctgggactgaggtgaagagcgtgggctnagtgaaggtctccgtgacgaagacttcgtggactacctaccttcaccgtactactatatcgacacgtgggtcgcccgacgacggtcccctggaacgaaggggtcttggagtggagtgggatggataccgacccgtaaagagttggtacgacccaaagtaaacttatagacctaccgtagtaccttttacggaacgggtccgtcgggtacaccgtgtaccgaccgagacgacgactanctaacgacaaaacacctagtaccttagaacgtggtacgttacggaaaccctcgacccgtacggacccgtacggtaacccggtcgtttacgttttaacgg

SEQ ID NO: 375439 - DNA, 585 bp, Homo sapiens
  misc_feature: GZ8MTXP02HNHSO.51.82.H05.1.454.CMB.2.raw
  modified_base (264)..(264): a, c, t, g, unknown or other
  modified_base (404)..(404): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagccgtgggcctnagtgaagtctcctgcaagcttctggataccaccttcaccgactactatatgcacgtggtgcccgacacggccccctggacaagggtcttgaggtggagtgggatgggactaccgaccctaaagagtgggtcgacccgaanaaacttactgaccgtaacgtaagttacgttttacggacggggtcgttacggggttacaaccgacgtacgaaccgagaccgaacacatacgagacaaacgtacgactactacacgtaggacgtttacgacccgtaacggtaccacggaacccggacgtaccgggtcccgtttagttttacgg

SEQ ID NO: 375440 - DNA, 681 bp, Homo sapiens
  misc_feature: GZ8MTXP02IQLH7.51.82.H05.1.454.CMB.2.raw
  modified_base (244)..(244): a, c, t, g, unknown or other
  modified_base (261)..(261): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgccgccctcagtgtctcggggccccagggcaggaggtcaccatctcctgcactgggaacacgttccaacngtcggggactaggttanaatgtacactggtaccagcaacttccgaaggaaccacgacccccaaactcctacatccatgactaccaagtaaacgtccggacccgtcggggtccccctagaccgtacttcgtctcggtcctccgtaaagtctacgacctaccgttcacgtccctcccgtagccctatccgacgttcgggaccctacgacgtaccgtaggacggtaattcggacggtccttacggtaacctttatttaccgtacgaccctaaacggttccctaagtcgaaccgtaggccgtaacggtcgtaccggtacgttcggtccgtttaggggtttccggggtttcccggaccggggttaacccgggaaacccgtaacggggtcccgttaccgggtaaccccggttaccggttaacgggttacccaaacccccgggg

SEQ ID NO: 375441 - DNA, 547 bp, Homo sapiens
  misc_feature: GZ8MTXP02F7FTS.51.82.H05.1.454.CMB.2.raw
  modified_base (384)..(384): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcacgtgggaacagttccaacagtcggggcaggttataatgtacactggtaccagcaacttccaggaacacgaccccccaaatcctcactccatcgactaccagaaactccccggccccgtcggggtccctgaccgattctcgtggctccaagtctgacncttcacgccctccctggcccatccaccgtgggcctccgagctggagatggagctgtactacttactcgcctagtcctagtcgacagcgagcctagactcgtcgttggttcgggttttccgggccgggtacgggaaccgtacggtcgtaccggtaccgttccgg

SEQ ID NO: 375442 - DNA, 589 bp, Homo sapiens
  misc_feature: GZ8MTXP02JPEKG.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagccgtggggcctcagtgaaggtctcctgacaagacttctggatacaccttcaccgactactatatgcacgtgggtgcccgacacggccccctggaacgaaggggtcttgggagtgggtagtggggagtgggactaccggaacccgtaaaggaagtagggtcgacccaaacgaaaactagtacgacaacgtagtacttttacgacgggtcgtacggggtccaccgtacgtacgaacccgacgacgaaccaactactaccgtagacaaacacacgtactacgtagtacgacgttcgaacgtaacgccgtacgaccgactaccggtccgttagttttacg

SEQ ID NO: 375443 - DNA, 522 bp, Homo sapiens
  misc_feature: GZ8MTXP02FTI6I.51.82.H05.1.454.CMB.2.raw
  modified_base (388)..(388): a, c, t, g, unknown or other
  modified_base (400)..(400): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgagagcgtgggctcagtgaaggtctcctgcaagacttctggatacaccttcaccgactactatatgcacgtgggtcgccgacacggcccctggacaaggggcttggagtggatgggatggatcgacctaagaatgtgccanaaactatgacanagtactttacgagggtcgtgggtcaccagtcgaaccgagcgacacatactagacaaacactagtcctaacagtacgacgttacgaccaaggcctacggaccgacgacggccgttagtttacg

SEQ ID NO: 375444 - DNA, 656 bp, Homo sapiens
  misc_feature: GZ8MTXP02GCHQ6.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccgaggtgcagctggtgcagtcgtgggactggaggtgaagagccgtgggcctgagtgacggtctcctgacaagtcttcgtggataccaccttcaccgactactatatgctacgtggtcgccgacacggccctaggacagggtcttggagtgggagtgggagtaggactaccgaaccgtaagtaagtgtacgacccaaacgtaaaactagtacgacgtaacgtacgttaccgttttacggaacggggttcgttacgggttaccaacccgtaagttaccgaaaccccgaaggacccgaactaacgaactttaccgaaacgaaccaaaaccgtaactaacgttaccgtaaaccgtaacggttagggtaacgttaccgaacccgaacggtaccccgtaacggtaacccggaaccggtaccgggttaccgtttacggtttttacgg

SEQ ID NO: 375445 - DNA, 535 bp, Homo sapiens
  misc_feature: GZ8MTXP02IU5ZC.51.82.H05.1.454.CMB.2.raw
  modified_base (393)..(393): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactggaggtgaagaagccgtggggcctcgagtgaaggtctcctgacaagacttctggatacaccttcaccgactactatatcgactagtgggtgccgacacggccccctggacaagggctggagtggagtgggatggatcgacctaagatgtnacaacaaactatgacacagtactttagagggtcgtgggtcacatacgaccagacgacacatactacgacaacaacagtacctacaacgtggtacgttacgaacaacgacgtacgacccgacgaccggtccgttacgttttag

SEQ ID NO: 375446 - DNA, 632 bp, Homo sapiens
  misc_feature: GZ8MTXP02IHWUP.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacagtcggggctaggttataatgtacactggtaccagcaacttccaaggaacacgacccccaaatccctacatccatgaataccagaaactccggcccgtcggggtccccctgacccgtatttcctacgtcggactcccgtaaagttctacgtaacctacctttcaacgtccccctcccgtggaccctaatccacgttgggcctacccgagtaccgtggaacggtatcggaaggtcttacggtaactttacttaacgtcggacctaacggttccttaagtacggaaccacgaccgtagggcctacggtactggtccgttggtttcggggtttaccggccggtacgggaacccgaaggtccgtacggaacccgtttccgtaacggtacgaaccgg

SEQ ID NO: 375447 - DNA, 591 bp, Homo sapiens
  misc_feature: GZ8MTXP02I9N8X.51.82.H05.1.454.CMB.2.raw
  modified_base (336)..(336): a, c, t, g, unknown or other
  modified_base (423)..(423): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacaggacgcccactcccaggtgcagctggtgcagtctgggactgaggtgaagagccgtgggcctcgagtgaaggtcctccgtgacaagtacttcgtggataccaccttcaaccgtactactatatgactagtgggtncccgacgacggcccctaggacgaagggtcttggagtggagtgggatgggactaccgaaccgtaagagtcggtacaccaacaaacttnacgacaacgacgttacgtttacgagggttcgtacgggtaccaaccgtagtacgaacccagaccgaacaacacttacgaacgacaaaccacgtacgttacaacgtacgtggtaacgttcgaaccgcggtaccgacggacccgaccgtaccggtaccgtttagtttttag

SEQ ID NO: 375448 - DNA, 589 bp, Homo sapiens
  misc_feature: GZ8MTXP02FJZOR.51.82.H05.1.454.CMB.2.raw
  modified_base (463)..(463): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatcctcctgcactggggaacagttccaacagtcggggcaggttataatgtacactggtaccagcaacttccaggaaccacgacccccaaactcctacactccatcgactaccagaaactccccggcccgtccggggtccctcgaccgacttctctcgctccagtctagactacttcacgtccctccctgcccactcacgtgggcctccgacgacgtggacggatgacggctagtactatttaccncgcctagtacctagtcgaacgacgcgacggtcctaggtctcggtcgttacgggtttcggggttttaaccgggggccggggtacccggggaacccgaaggtccgtacggtaccccggtttaacccgg

SEQ ID NO: 375449 - DNA, 602 bp, Homo sapiens
  misc_feature: GZ8MTXP02HMZJH.51.82.H05.1.454.CMB.2.raw
  modified_base (283)..(283): a, c, t, g, unknown or other
  modified_base (327)..(327): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccgaggtgcagctggtgcagtcgtgggactggaggtgaagagccgtggggcctcgagtgagtctccgngacaagtacttgtaggactaccaccttcaaccgacttactatangactacgtgggtgcccgacgaccggcccctggaacgtaagggcttggagtaggagtggggtatggaacgttacccgaaaccgttaaagaacgttgggacacccaaactaaactgacgacaacgtagttacgtttagacgggtcgtagggtaccaactagacgaccaggacccaatactatacaagaacaacactagtacctagagttacggacgttaccgaacgtaacgtcccgtaaccggacccggtacgtacccggtcggttttattttacgg

SEQ ID NO: 375450 - DNA, 572 bp, Homo sapiens
  misc_feature: GZ8MTXP02FTY5Y.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctgggccccagggcagaggtcaccatctcctgcactgggaacagttccaacatcggggcaggttataatgtacactggtaccagcaacttcagaacacgacccccaaactcctcatccatgataccagaaactccggcccgtcggggtccccctaggacccgtattcctctcggcctccgaaagttcctagacctacctttcgacgtcccctccctcggccctaatccacgtcgggacctaccgagacctgaacggagtaggaacggctacggacttagttaacgtcgcctaacgttcctagtcgactagcgaacgctgactgcgttcggttcgggtttacgcgggacggaacgagtcgtacgtaccgtacgtacggtcaaccgg

SEQ ID NO: 375451 - DNA, 599 bp, Homo sapiens
  misc_feature: GZ8MTXP02FWW94.51.82.H05.1.454.CMB.2.raw
  modified_base (241)..(241): a, c, t, g, unknown or other
  modified_base (265)..(265): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcgagtgtcgtcggggccccagggcaggagggtcaccatctcctgcacgtggaacngtccaacagtcggggcaaggttanaatgtaacacgtgtaccagcaacttccgaaggaaccaccgacccccaaaactccctacaactcccgaattacgaactaaccaaagtaaacgtcccccgggaccccgttccggggtccctacgaccgtattcctcgcggtcctacctaagtcctacgactacttcacgccctccgcgccactccacgtcggcctaccgagacgtaggaagcgtaggagtctacgtacttaacgtacgtcgacctacgtcctagtcgaacgacgcgaggtcgtagtacgtcgtcgtggttcggtttccggcgggtacggaccgaacgtcgtaccgtaccgttaccg

SEQ ID NO: 375452 - DNA, 559 bp, Homo sapiens
  misc_feature: GZ8MTXP02G2KE6.51.82.H05.1.454.CMB.2.raw
  modified_base (326)..(326): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagccgtggggcctcagtgaaggtcctctgcaagcttctggatacaccttcaccgactactatatgcacgtgggtncccgacacggcccctggacgagggcttggagtgggagtggggatgggactaccggaacccgtaagaagtggtacgaccaacgtaaactatcgacaacgtacgtacttttacggagggtcgtcgggtacaccgtagtacgaccagaccgacaacgattacgagactaacacgatacctaacaggtacggacgttcgaccaagccctacgaccgacgaccggtccgttagtttag

SEQ ID NO: 375453 - DNA, 603 bp, Homo sapiens
  misc_feature: GZ8MTXP02FWAWO.51.82.H05.1.454.CMB.2.raw
  modified_base (230)..(230): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtncagtctgggactgaggtgaagagctgggcctgagtgaaggtctcctgacaagtacttcgtggataccaccttcaccgtactactatatgctacgtgggtgccgacacggcccctaggaacgaaggtcttggagtgggagtgggagtggataccgaaccgtaaagaacgtggtacgacccaaacgtaaaactagtacgactaacgaagttacgttttacggaacggggtcgttcggggtaccaacccgtaagtaccgaaacccgagaccgaacaacacttacaacgaccaaaacacaacgttacaaacgtagtacggtaacgttcgaaaccgtaagtccctacggacccgacgtacggtccgtttagtttttag

SEQ ID NO: 375454 - DNA, 659 bp, Homo sapiens
  misc_feature: GZ8MTXP02JQ656.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagccgtggggcctcgagtgaaggtctcctgcaagacttctggatacaccttcaccgactactatatgctacgtgggtgaccgacgacggcccccgtaggacgaagggcttggagtggagtgggagtgggactaccggaaccctaagaagtgggtacgacccaacaaactatacgaccaacgtagttaccttttacggacggggtcgttacggggttaccaaccgtacgtacggaacccgaacggaccggaaacctaaccgaactttacccgtaaacggaacccaaaacccgtaacgtaaccggttaacctaaaccgttaacggttagggtaacgtttacggaaacccgaacggtacccgtaacggaccccggaacgtaaccccgggtcccggtttagtttttaacggg

SEQ ID NO: 375455 - DNA, 498 bp, Homo sapiens
  misc_feature: GZ8MTXP02F767Q.51.82.H05.1.454.CMB.2.raw
  modified_base (312)..(312): a, c, t, g, unknown or other
  modified_base (321)..(321): a, c, t, g, unknown or other
  modified_base (442)..(442): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgagagctggggctcagtgaagtctcctgcaagacttctggatacaccttcaccgactactatatncactgggtncgacagcccctggacagggcttgagtggagtggagtggatcgaccctaagaactggtcgacacgaaactagtgacacagacttttacgagggtctgggtcaccgatcgaccgagcgacacntcgagcaacacagtcacatgagttcgacaagcctacgaccgacacggtctgtttag

SEQ ID NO: 375456 - DNA, 589 bp, Homo sapiens
  misc_feature: GZ8MTXP02HIRIQ.51.82.H05.1.454.CMB.2.raw
  modified_base (244)..(244): a, c, t, g, unknown or other
  modified_base (253)..(253): a, c, t, g, unknown or other
  modified_base (406)..(406): a, c, t, g, unknown or other
  modified_base (415)..(415): a, c, t, g, unknown or other
  modified_base (424)..(424): a, c, t, g, unknown or other
  modified_base (450)..(450): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacgagggtcctgggcccagtctgtactgacgcacgccgcctcagtcgtccgtcggggccccaagggcaggaggtcaccatctcctgcacgtgggaacngttaccaancgtcgggactaggttaataatgtacacgtcggacagacaactccgaagaacaccgaccccaaactccacactccgatcgaactaaccgaagtaaacgtccccggacccgtccggggtccagtaccgtacttctcgtgcctaccgtaagtctanactactacncgccctccngccatcacgtcgcaccgagacagagnacggagtctagaacttacttaacgcgacctacttaccttagaacgaaccgttaggcaacggctaccgtacgtcgtcgttggttcgggtttcgggtcgggaccgggtaccggaacgacgtaccggtaccggttaacccgg

SEQ ID NO: 375457 - DNA, 760 bp, Homo sapiens
  misc_feature: GZ8MTXP02FEQ4K.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagagggtcaccatctctgcactgggacagttccaacagtcggggcaggttataatgtacactggtaccagcaacttcacggaaccacgacccccaaaactcctacatccagtacgaactaaccaagtaaaacgtccccgggtccccgtaccgggggtcccctacggacccgtacttccttcgtcgggaccttaccgtaaacgttccttacgaaccctaaacctttccgaacgtcccccgttacccccgttgggacccctaagttcccgaaccggttcgggggacccttacccgaaacgtaaacgttacgggaaacggggacgttaggggaacggggtccttaacgggtaactttaaaccgtttaaacccgttcggacccgtaacggtttcccaagttaccggaaaccgaacgtacgtacggggaccttacggtaccgttgggttcccgttggggttttaccgggggtttttaacccgggggcccgggggtaacccgggggtaacccccgaaagggtttcccgaaccggggttcccccggtttaaaccccggg

SEQ ID NO: 375458 - DNA, 526 bp, Homo sapiens
  misc_feature: GZ8MTXP02F9GB5.51.82.H05.1.454.CMB.2.raw
  modified_base (282)..(282): a, c, t, g, unknown or other
  modified_base (320)..(320): a, c, t, g, unknown or other
  modified_base (468)..(468): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgagaagctgggctcagtgaggtctctgcaagcttnggatacaccttcaccgactactatatgcacgtgggtcncgacacggcccctggacgaagggcttgagtggagtgggatggatcgacctaagaatggtcgacaagaaactatagacacagtactttcgacgggtcgtcgggtacaccagtcgaccagcgacaacatactagacaacgacagtcctanagtggtacgttcggaaccaagtaccgtacggaaccgacgacggtccgttgttttaacg

SEQ ID NO: 375459 - DNA, 552 bp, Homo sapiens
  misc_feature: GZ8MTXP02IFG4E.51.82.H05.1.454.CMB.2.raw
  modified_base (208)..(208): a, c, t, g, unknown or other
  modified_base (231)..(231): a, c, t, g, unknown or other
  modified_base (354)..(354): a, c, t, g, unknown or other
  modified_base (414)..(414): a, c, t, g, unknown or other
  modified_base (471)..(471): a, c, t, g, unknown or other
  modified_base (474)..(474): a, c, t, g, unknown or other
  modified_base (487)..(487): a, c, t, g, unknown or other
  modified_base (495)..(495): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacncccactcccaggtgcagctggtncagtctgggactggaggtgaagagcgtggggcctcagtgaaggtctcctgacaagtaccttcgtaggactaccgtacccttcaacccgtacttaactatatcgactacgtgggtgccgtaacncggccccctaggacgaagggcttggagtggagtggatggatcgaccgtaagagtggtacncaaacaactatgaccagagtactttacgagggtctgggtacacagtcgaccaagcanacntactagcaacganagtctaanagtagacgttcaacgaacgtaccctacggacccgacgtaccgggtcgttcgtttaag

SEQ ID NO: 375460 - DNA, 611 bp, Homo sapiens
  misc_feature: GZ8MTXP02JJZ5V.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcaggagggtcaccatctcctgccacgtgggaacagttccaacagtcggggcaggttataatgtacactggtaccagcaactccaggaacacgacccccaaactcctcactccattactaccaagaaactccggccccgtcgggggtccctcggaccgtattctactcggcctaccagtctcgacctaccttcacgtccctcccgtcgccctactccacgtcggcctccgacgactaggagtagtggacggctaggtaacttattaccgtcgtacccgtacgttccctaagtcgaacgagacgtacggctacgtacgtgtccgttggttcgggttttccggggccgggtacccgggtaaccgaacggtccgtacggtacccggttccgtacggtccgaccggaaccccgg

SEQ ID NO: 375461 - DNA, 556 bp, Homo sapiens
  misc_feature: GZ8MTXP02HZRQM.51.82.H05.1.454.CMB.2.raw
  modified_base (354)..(354): a, c, t, g, unknown or other
  modified_base (423)..(423): a, c, t, g, unknown or other
  modified_base (428)..(428): a, c, t, g, unknown or other
  modified_base (446)..(446): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcaggagggtcaccatctcctgcacgtgggaacagttccaacagtcgggcaggttataatgtacactggtacagacaactccaggaacacgacccccaactccctcactcatgactaccagaaactccggccgtcggggtcccctgacccgtnttctctcggctccgaagtctacgacctactcacgtcccctccgtcgcccatcactcggctccagtacgngagangacggctgtactattacncgacacgtacctataggacagacgaggactaggactcgtcgttacggttcgggtttcgggccggtcggaaccgtacgtccgtacggtaccgtccgtaacggtctaaccgg

SEQ ID NO: 375462 - DNA, 514 bp, Homo sapiens
  misc_feature: GZ8MTXP02GIZH8.51.82.H05.1.454.CMB.2.raw
  modified_base (230)..(230): a, c, t, g, unknown or other
  modified_base (386)..(386): a, c, t, g, unknown or other
  modified_base (391)..(391): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtncagtctgggactgaggtgaagagcagtgggctcagtgaaggtctcctgcaagacttctggatacaccttcaccgactactatatgcacgtggtcgcgacacggcccctggacgaagggcttgagtggatgggatggatcgacctaagatgtgcaanaactngcacagtactttgaggtctgggtacaccagtacgacagcgaacacatcgagacaaacacgacgtacctacagtcggattacgaaccgtacgaccgtacgacccgaacgtacggtccgtttagg

SEQ ID NO: 375463 - DNA, 600 bp, Homo sapiens
  misc_feature: GZ8MTXP02F7VK7.51.82.H05.1.454.CMB.2.raw
  modified_base (291)..(291): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctggggactgaggtgaagaagccgtggggcctcagtgaaggtctcctgcaagcttcnggatacaccttcaccgactactatatgcatgggtgcccgacgtacggcccctgggaaccaaggggtcttggagtgggaagttggggatgggattccgaaccctaaaggaaacttgggtcgaccaacgaaaacctatagcaacacgtaacttttcgagggtctggggtcaacctagtacgacccgagccggaacaccaaatccgtaagacaaaacaccgaagtaccgtaaacacgttaggaacggttcgaaccgaacggccctacgggaaccccgaccgtaacccgggtcccggtttagtttttaacggg

SEQ ID NO: 375464 - DNA, 678 bp, Homo sapiens
  misc_feature: GZ8MTXP02H0QG5.51.82.H05.1.454.CMB.2.raw
  modified_base (252)..(252): a, c, t, g, unknown or other
  modified_base (455)..(455): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcggggccccagggcagacggtcaccatctcctgcacgtaggaactcgtaccaacgnggtcgggactaaggttataagtcgtaactacgtacggtaccagtactaaccttcgaacggaacccacccgaccccctaaactcccactactactatacgaacctaaccgaaagtaaccgtccccgggtcccggttaccggggtcctacggaccttacgttcctcgtcgtacctaccgaacgttctacgtactacccgttaccncccgtccctccgtcgacctacgtaccgacgtcggtacctaccgtacgacgtaggtaggtacgtacgggtacgtacgtacgtaacttacgttaccgtacgtaccgtacgttacctagaacgtaacgacgtacgtacggtacgtacggttacgtcggttacgttcgggtttacgggttaaccgggaccgggtacggaccgtacggtccggttaccggtaccgtcg

SEQ ID NO: 375465 - DNA, 722 bp, Homo sapiens
  misc_feature: GZ8MTXP02GITDD.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgccccactcccaggtgcagctgggtgcagtcgtgggactggaggtagaagagccgtgggcctgagtgaaggtcctccgtgacaagtcttcgtggactaccgtacccttacaaccgtactactatatcgacacggtggggtcgacccgacgaccgggtcccccgtagggaaccgtaaggggtcttagggaggttaggggtaggttgggggaagttacggggaacgttaacccgggtaaaccccgttaaaaggtaaacggttcggggtaaccgaacccctaaaacgtaaaaccgttgtacgaacccgtaaacgttacgttaccgttttaccgggaggggtccgttacggggtaccaaccgtacgtaccgaacccgacgaccgaactaacgtactaccgtacgaaccaaaccgactacggttactaaacgaggttacgggtacgttaccgaaacccgtaacgtacccgttaaccggaaccccgtaccggtaccgggttaccgtttaggtttttaacgg

SEQ ID NO: 375466 - DNA, 699 bp, Homo sapiens
  misc_feature: GZ8MTXP02FUQNP.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcggggcccccagggcaggagggtcaccatctcctgcacgtgggaacagttccaacagtcggggcaaggttataatgtacactggtaccagcaacttccaaggaacacgacccccaaactcctcactccatgactaccaagaaactccccggccccgtccggggtccctagaccgtacttcgtctcggcctaccgaagtcctagacctaccttcgaccgtcccctcccgtacggaccctacgttccaccgttcggggtacccttaccccgaagtaccgttagggaacgggaagttacgggacgggtccttaggtaaacctttaacgtttaaccgttcggtacccgttaacggttaccccttaagttacggaaccgtaaacgcggtaaacggtccgtacggtaaccgttcgggtaccgttttcgggtttaccgggggttttcccgggccgggggaaccgggtacccgtaaacgggtccgttaaccgggaccccggtttaacccgg

SEQ ID NO: 375467 - DNA, 660 bp, Homo sapiens
  misc_feature: GZ8MTXP02JYE64.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtcggggccccagggcaggagggtcaccatcctcctgcacgtagggaactacgttaccaacgagtcggggactaaggttaataagtcgtaacacgtcggtaaccagacctaaacttaccgaaggaaccaccgaccccctaaactccctacactccatacgaactaaccaagtaaacgtccgggtaccccggttccggggtccccctacgtaccgtactttccgtcgtcggtaccttcccgaaacgttctacgacctacttccgacgtccctcccgtcgacctactcgacgtcggctccgaagacgtggagagtaggacgtctacgtacttacttacgtcgtacctagtacctagtacgaacgacgacgtacgggtctaggacgttcggtcgttcggggtttcgggtttaccggggaccgggtaccggaaaccgtcggtccgtacggtacccgtacgtacggaccgaacccgg

SEQ ID NO: 375468 - DNA, 558 bp, Homo sapiens
  misc_feature: GZ8MTXP02FXWIJ.51.82.H05.1.454.CMB.2.raw
  modified_base (182)..(182): a, c, t, g, unknown or other
  modified_base (261)..(261): a, c, t, g, unknown or other
  modified_base (270)..(270): a, c, t, g, unknown or other
  modified_base (283)..(283): a, c, t, g, unknown or other
  modified_base (320)..(320): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctnttcttggtggcagcaaccacaggagcccactcccaggtgcagctggtgcagtctgggactgaggtgaagagctgggctnagtgagtcnctgcaagacttcnggatacaccttcaccgtactactatatgcactgggtnccgacacggccctggacaaggcttggagtgagtgggatagggataccgaacctaaagtaaagtggtacgaccaaacaaaacgtagtacgacacaagtacttttacgagggtcgtgggtaccaaccgatacgaccgagcgacaactatacgtaagacaaaactacgagttactaacgacgtagggtacgttcgaaccgaacgccgtacgaaaccggacgaaccggtccgtagttttaag

SEQ ID NO: 375469 - DNA, 546 bp, Homo sapiens
  misc_feature: GZ8MTXP02IOEIZ.51.82.H05.1.454.CMB.2.raw
  modified_base (207)..(207): a, c, t, g, unknown or other
  modified_base (230)..(230): a, c, t, g, unknown or other
  modified_base (329)..(329): a, c, t, g, unknown or other
  modified_base (391)..(391): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggancccactcccaggtgcagctggtncagtctgggactgaggtgaagaagccgtggggcctcagtgaaggtctcctgcaagcttcgtggatacaccttcaaccgactactatatgcacgtgggtnccgacacggcccctggacaagggcttgagtggatggggatggactcgaacctaagatggtanaccgaacaaaactatacgacacagtacttttacgagggtcgtacgggtacaccgagtacgaccgagaccgaacaactactacaacgacaacacacgtactacagtagacgttacgaccgaacgccgtacgaccgacgaccggtccgttagtttag

SEQ ID NO: 375470 - DNA, 597 bp, Homo sapiens
  misc_feature: GZ8MTXP02IG1CC.51.82.H05.1.454.CMB.2.raw
  modified_base (202)..(202): a, c, t, g, unknown or other
  modified_base (207)..(207): a, c, t, g, unknown or other
  modified_base (221)..(221): a, c, t, g, unknown or other
  modified_base (257)..(257): a, c, t, g, unknown or other
  modified_base (344)..(344): a, c, t, g, unknown or other
  modified_base (426)..(426): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccanaggancccactcccaggtncagctggtgcagtctgggactgaggtgaagagccgnggggcctcgagtgaaggtctcctgacaagtacttcgtaggataccaccttcaaccgactactatatgacacgtgggtcacccgaacnccggtccccctggaacgtaacgggtcttggagtggacgtggggaatgggatccgaacctaagagttggcgactaacaaactntagacacgtacgtactttacggacggtcgtcgggtacacccgtagtaccgaaccgagaccgacaacatacgtaacgaccaaacactaacgtactaaccgagttacggtaacgtttacaaccgtaacgtacccgtacgacccgaacgtccgggtaccgtttacgttttacgg

SEQ ID NO: 375471 - DNA, 577 bp, Homo sapiens
  misc_feature: GZ8MTXP02GW47J.51.82.H05.1.454.CMB.2.raw
  modified_base (330)..(330): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagccccactcccaggtgcagctggtgcagtctgggactgaggtgaagagccgtggggcctgagtgaaggtctcctgcaagtcttcgtggataccaccttcaccgtactactatatgcagtgggtnccgacgcggtccctggacgagggcttggagtggagtgggatggatccgaaccgtaagaagtgtacgaccaacaaactatcgacacgtagttacgtttcgacggggtacgtggggtaccaccgtagtaccgaccgaggaccaacactactacgtaacgacctaaactactactttaccgtaacagttacgggtacgtacgaccgaacgtccgtaccggaccgaccggtaccggttcgttagttttcgg

SEQ ID NO: 375472 - DNA, 597 bp, Homo sapiens
  misc_feature: GZ8MTXP02F2259.51.82.H05.1.454.CMB.2.raw
  modified_base (294)..(294): a, c, t, g, unknown or other
  modified_base (335)..(335): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtcgtgggactgaggtgaagagccgtgggcctcgagtgaaggtcctcctgacaagtacttgnggactacaccttcaccgtactactatagtgcacgtgggtcncccgacgacggcccctaggacaagggtcttggagtggagtgggaatggataccgaacctaagagtggagaccaacgaaactgtacgacacgtaacgttactttacggacgggtcgtacggggtaccaccgtaagtcggaaacccagggaccaacactactaccgagaaccaaacgactacggtactaacgacgtagggtacgttaccgaaccgcgtaccgtaccggaacccgtacgtaaccgggtccgtttagtttttaagg

SEQ ID NO: 375473 - DNA, 660 bp, Homo sapiens
  misc_feature: GZ8MTXP02JY6A1.51.82.H05.1.454.CMB.2.raw
  modified_base (474)..(474): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaactcccctgagagctccgttcctcaccatggactggacctggagatcctcttcttggtggcagccaaccacgaggacgcccactcccaggtgcagctggtgcgagtcgtgggactggaggtgaagacgccgtgggctgagtgagtctcgtgacaagtctcgtagtactacctacccttacacccgtactacttatacgtcgccgtagtcgggtcgaccccgaccgaccggtcccgaggaacgaacggggttcttggggacggtggggtagtggggtacgttgggaaccgtaccggaaacccgttaaaggtaacgtacgggtaccaacccgaaataaacgtanacgacgtagtaacgttacgtttacgggacgggtcgtacgggacctaaccgtacgtaccgacgacgtaccgaaccagtacctacgaactaacaaaccgtactacgtaacccgtaagtacggtacggtacgtaccgacgtaaccgcccgtaacgacccggaccgtacgggttaccgtttagtttacgg

SEQ ID NO: 375474 - DNA, 665 bp, Homo sapiens
  misc_feature: GZ8MTXP02H6164.51.82.H05.1.454.CMB.2.raw
  modified_base (207)..(207): a, c, t, g, unknown or other
  modified_base (230)..(230): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggancccactcccaggtgcagctggtncagtctgggactgaggtgaagagcgtggggcctcgagtgaacggtctccgtgacgaagaccttcgtggactaacctaccctttccaaccgtacttaccttatatgactacgtggggtcgaccccgacgaccgggtcccccgtagggaccgaaggggttccttagggagggttagggaggtggggaagtggggtactacccggaaccctaaaggaacgtgggtacgacccaaacgaaaacttagtaggaccaacgtagttaccgttttacggaagggttccgttacggggtaccaccgagtacgaacccgagaccgacaacgtataacgtacgtaaccaaccgtagtacgttactaacgtacgtacgggtacgttacgaaccgtccgtaacccgtaccggaaccgtaccggccggtttaccgtttagtttttacgg

SEQ ID NO: 375475 - DNA, 732 bp, Homo sapiens
  misc_feature: GZ8MTXP02JIYDN.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtccgtggggcccccagggcaggagggtcaccatctcctgcactgggaacagttccaacatcggggcaggttatagtgtacactggtaccagcaactccaggaacacgacccccaaactccctacactccaatcgaactaaccaacgtaaactccggaccccgtcggggtcccccctacgacccgtattccgtcgtcggtacctccgtaacgttctacgaacctaccgttaccacgtccccttcccgtcggtaccctactccgtaaccgtcggggtaccctacccgaacgaaccgttgggaaacggtaagttacgggaacggtcgttacggtaactttaacgtttacccggatacccgtacgttaccctagttacgaaccgaacgtcgaacggttccgttacggaacctttcgggtacgtttccgggggttttcggggtttttcccgggggacccgggggtacccgggaacccggtacgggttacccgtacccgggttaacccccggtttacccgggttaaaaccgggttccggtaaacccccggg

SEQ ID NO: 375476 - DNA, 581 bp, Homo sapiens
  misc_feature: GZ8MTXP02H977Y.51.82.H05.1.454.CMB.2.raw
  modified_base (229)..(229): a, c, t, g, unknown or other
  modified_base (329)..(329): a, c, t, g, unknown or other
  modified_base (404)..(404): a, c, t, g, unknown or other
tcagcgatcgtatacacgaccggtgctcgatttagtcgagctctctcgcgggcacgaccggtgctcgatttagtcgagctctcagagagaaaggggagcatcacccagcaaccacatctgtcctctagagaatcccctgagagctccgttcctcaccatggactggacctggaggatcctcttcttggtggcagcaaccacaggagcccactcccaggtgcagctggtncagtctgggactgaggtgaagagcgtgggcctcgagtgaaggtctcctgcaagacttcgtggataccaccttcaccgtactactatatgccacgtgggtncccgacgacggccccctggacgaagggcttggagtggagtgggagtggataccgacctaagagtggtagaccaanaaactagtacgacaacgtagtactttagacgggttcgtcgggttacaaccgtagtaccgaccgaggaccgacgaactactacacgacaaacacgtaacgtactaacgagttacggagttaccgaaccgtaacgacccgtacgaaccccggtacgtaccggtccggttaagttttacg

SEQ ID NO: 375477 - DNA, 729 bp, Homo sapiens
  misc_feature: GZ8MTXP02HZOBM.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagttgtcgtcggggcccccagggcagagggtccaccatctcctgcactgggaacagttccaacagtcggggctaggttataagtgtacacgtcggaccagacctaacgttccgaaggaaccaccgaccccccaaaactccctacacttaccattacgactaaccaagaaacgtcccggcccgtccggggtccccctgtacccgtacttctcgtcggtactccgtaagtctacgacctacttcacgtcccctcccgtcgccctatcgacgtcgggtcctaccgtacgacgttacgacggtacgtacggacggtacgttacgtaacgtttaccgtttacgtaccggaccgttacggttacccttaacgtacggtaccgacgaccgtaacgggtaccttacggtaacccgttcggttacccgggtttagggttttccgggggtttttccgggggaccccgggggttaccgggggtaaacccgtacgggttacccggtacccgggtaaccccggtttacccggtaccgggtttacccggaaaccccgggg

SEQ ID NO: 375478 - DNA, 590 bp, Homo sapiens
  misc_feature: GZ8MTXP02JE1AO.51.82.H05.1.454.CMB.2.raw
  modified_base (338)..(338): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctggggactgaggtgaagagccgtggggcctcgagtgaaggtcctccgtgacaaggtacttcgtggactacaccttccacgactactatatcgcacgtgggtcncgacacggcccctaggacaagggcttgagtggagtggatggatcgaacctaaagaacgtggtcgaccaaagtaaactatcgacaacgtacgttacttttacggaggggtcgttacggggtaccaccgtagtaccgaaccgagacccgaacaactacctacgaacgacaaaacgactagtacctaacgacgttaggacgttacgaccgtaacgccgttacgaccgaccgtaaccggtccgtttaggttttacg

SEQ ID NO: 375479 - DNA, 717 bp, Homo sapiens
  misc_feature: GZ8MTXP02JV082.51.82.H05.1.454.CMB.2.raw
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtcgtcgtcggggccccagggcagagggtcaccatctcctgccacgtgggaactacgttacccaacagtcggggactaaggttataagtgtacacgtcggtaccagaccaacttccgaacggaaccaccgaccccctaaactccctacactccatcgaactaccaacgtaaacgtccccggtaccccgtccggggtaccctacggaccgtacttccgtcgtcggacctacccgtaagtcctacgtacctaccgttccaaccgtccccttcccgtcggccctagttacccgaccgtcgggtaccctacccgaacggtccgttagggaacgggtacgttacgggaacggtcgtaacggttaacttaactttaccgtaccggtaccctacggtttaccctagtacggaactacggacgttacgggccttaggtacctcggtccggtttggggtttccggggtttaaccgggggaccgggtaacccgggtaaccgtacgggtcccgtaccggggtaccccgtttaaccggg

SEQ ID NO: 375480 - DNA, 607 bp, Homo sapiens
  misc_feature: GZ8MTXP02ID74J.51.82.H05.1.454.CMB.2.raw
  modified_base (208)..(208): a, c, t, g, unknown or other
  modified_base (222)..(222): a, c, t, g, unknown or other
  modified_base (231)..(231): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacncccactcccaggtncagctggtncagtctgggactggaggtgaagagccgtggggctcgagtgaaggtctcctgacaagtacttcgtgactaccaccttcaaccgactactatatcgctacgtggggtcaccgacaccgggtccccaggaccgaaggggtcttggaggtgagtgggactggactccgaacctaagaagtgggtacaccaaactaaactagtacgacaacgtacgttacttttacggacgggtacgtgggttacacctagtcgaacccgagcgaactacattacgacgaaccaaactacctagtacctaaacgacgttacgggtacgtttacgaaccgtcggtacccgtacgaccccggaccgtaccgggttccgtttacgtttttaacg

SEQ ID NO: 375481 - DNA, 574 bp, Homo sapiens
  misc_feature: GZ8MTXP02FN5MF.51.82.H05.1.454.CMB.2.raw
  modified_base (292)..(292): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactggaggtgaagagccgtggggcctcgagtgaaggtctcctgcaagcttcgnggactacaccttcaccgtactactatatgcagtgggtgccgacgacggcccctaggacaagggcttggagtgggagtggggataggactccgaaccgtaagaagtggtacgaccaaataaactatgacaacgtacgtacttttacggacgggtcgttacggggtaccacctagtaccgaaccgaggaccgaacacataccgagacaaacacgagtactacagtcggacgttcgaacccgaagacccgtacggaaccgaccgtacggtaccgtttagttttag

SEQ ID NO: 375482 - DNA, 738 bp, Homo sapiens
  misc_feature: GZ8MTXP02IZOV1.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtggggccccagggcagagggtccaccatctcctgcacgtgggaacagttccaacagtcgggctaggttatatgtacacgtggtaccagcaacttccgaaggaacaccgacccccaaactcctacactaccatacgactaaccaagaaacctccggtcccgtccgggggtacccctacgaccgtacttccgtcgtcggcctaccgaagtccttacgacctaccgttacgaccgtccccttcccgtcggtacccctaacgtcccgtacccgttcggggtaccctacccggaacgtacccgtagggaaacggtacgttacgggaaacggtccgttaacggtaacctttaccgtttaaccgtaccggtaccccgtaacggtttacccctaaggtaaccggaccgtaacggaccgtaacgggttacgtacgtaccggttcgggtaccgtttacggggttttccgggggtttaacccggggcccggggtaaccgggtaaccgtacggtaccggttaccggtacccggttaccggtacggtaccgtaaccccggg

SEQ ID NO: 375483 - DNA, 678 bp, Homo sapiens
  misc_feature: GZ8MTXP02F4JPO.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgccccactcccgaggtgcagcgtggtgcagtcgtgggactggaggtagaagagccgtgggcctcgaggtgaacggtcctccgtgacaagtacttcgtggactacctacccttcaccgtactactatatcgctacgtggggtcgacccgacgaccggtccccctagggaacgaaggggtcttgggaggtggagtggggatggactaccgaaaccgtaaaggtaagtcgggtacgacccaaacgtaaaactacgtacgacctaacgtaacgttaccgttttacggacggggtacgttacggggtaccaacccgtagtacgaacccgaggacccaacgactaacgtaccgtaaacgaaccaaaacctacgtaacgttacctaaaccgtagttacggggtacgtttaccggaaaccgaacggtacccgtaccggaaacccggaccgtacccgggtaccgtttaggtttttaacgg

SEQ ID NO: 375484 - DNA, 599 bp, Homo sapiens
  misc_feature: GZ8MTXP02I9J30.51.82.H05.1.454.CMB.2.raw
  modified_base (199)..(199): a, c, t, g, unknown or other
  modified_base (205)..(205): a, c, t, g, unknown or other
  modified_base (221)..(221): a, c, t, g, unknown or other
  modified_base (230)..(230): a, c, t, g, unknown or other
  modified_base (265)..(265): a, c, t, g, unknown or other
  modified_base (509)..(509): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttctggtgcagcaaccanaggacnccccactcccgaggtncagctggtncagtctgggactgaggtagagaagccgtgggcctnagtgaaggtctctgactaagcttgtgactaccaccttcaccgtactactatactgctacgtggagacccgacgaccggccccgtaggaccgaagggtcttggaggtagggagttggggacgttggaactaccgtaacccgtaagaagttcgggacgaaccaaacgtaaactacgacgacgaacgtacgttactttacggaggtcggtcggactaccgagacgacacgacgacaactataccganaacaacacgtacgtacctaagtacggtagtaacgtcgaaccgaacgttccgaacgaccggacgtaccgggttaccgttaggtttttaacg

SEQ ID NO: 375485 - DNA, 536 bp, Homo sapiens
  misc_feature: GZ8MTXP02GD45U.51.82.H05.1.454.CMB.2.raw
  modified_base (238)..(238): a, c, t, g, unknown or other
  modified_base (420)..(420): a, c, t, g, unknown or other
  modified_base (439)..(439): a, c, t, g, unknown or other
tcagcgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggacagttccaanatcggggcaggttataatggtacactggtaccagcaacttccagaacacgcccccaaatcctcactccatgactaccgagaaactccggccctcggggtccccctgacccgtattctctcggctccaaagtctagaccacttcacgccctcctgcccatcacgtgggcctccgagactgagntagacggctgactattacngcccagtcctatcgacagcgaggctagactgcgtggttcggtttccggcggtacgggaaccaaggtccgtacggtacccgtcgtacggtacaaccgg

SEQ ID NO: 375486 - DNA, 700 bp, Homo sapiens
  misc_feature: GZ8MTXP02F3IS8.51.82.H05.1.454.CMB.2.raw
  modified_base (588)..(588): a, c, t, g, unknown or other
tcagcgatcgtatacacgaccggtgctcgatttagtcgagctctctcgcgggggcttcagctgtgggcacaagaggcagcactcaggacaatctccagcatggcctggtctcgtctcctcctcactctcctcgctcactgcacagggtcctgggcccagtctgtactgacgcagcccgcctcagtgtcgtcggggccccagggcaggagggtcaccatctcctgcacgtagggaactagttaccaacagtcggggactaaggttataatgtacacgtaggtaccagactaacttcaaggaaccacgaccccctaaactcctacatccatacgaactaaccgaaagtaaaccgtccggtaaccccggttccgggggtaccccccctacggacccgtaactttccgtacgtcggaccttcccgtaaagttcgtacgtaaccctaccgttaccgaccgtcccccttacccgtcggtaccctaacgtacctaaccggttcgggtacccttacccgaacggtaccgtaggtaacggagtacgggaacgtccgtaacggtaacttaactttaccgcgaccctacgtccgttaanacgacgacgacgacgtacgtacgtacgttcggtcggttcgggtttcgggttccgggaccgggtaccggaaccgtacggtccgtaccgtaccggtacgtaccggtacgaccgg

SEQ ID NO: 375487 - DNA, 677 bp, Homo sapiens
  misc_feature: GZ8MTXP02FVDXQ.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagagggtcaccatctcctgcacgtgggaacagttccaacagtcggggcaggttataatgtacactggtaccagcaacttccaaggaacacgacccccaaactcctacactccatgaactaccaagaaacgtccggaccccgtccgggggtcccccctcggacccgtatttcctacgtcggcctccgtaaagtctacgacctacttcgacgtccccttcccgtggccctagtccacgtgggccctaccgagtaccgtggaggacttaggaacggtctagtaacttacgttaccgtacgacccgtaacggttccctaggttacgaacgacggacgtacgggtccttaacggtacccgtggttccgttcggggttttaccggggttttacccggggccggggtacccgggtaaaccgtaacgggtccgttaccgggtacccccggtttacggtaaccggggttaccaaaccccgggg

SEQ ID NO: 375488 - DNA, 723 bp, Homo sapiens
  misc_feature: GZ8MTXP02JHMA7.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagccaaccacgaggacgcccactcccaggtgcagcgtggtgcagtcgtgggctggaggtagaagagccgtgggcctgagtgagtctctgacaagtctcgtagactaccaccttcaaccgactactatatcgctacgtgggtcgacccgacgaccggccccgtaggaacgagggtctgggtaggtgggtaagtggggaatacgggacgtacccggtaaacccgtaagtaaacgttcggtacgaacccaaacgtaaaacgttacgacgaacccgtaacgtaacgttaccgtttttacgggaacggggttcccggttacggggtaacccctaaccgtacgttaaccggaaccccgacgggtaacccaaaccgtaaccctacggtttaaccaaaacggaaacccgtaaaacctacgtaaaccggttaaccctaaacgtacgtacgggggttaacttacccggaacccgtaaccgaccccggtaacggaacccccggtaaccggtacccgggtttcccgtttaggtttttaacgg

SEQ ID NO: 375489 - DNA, 592 bp, Homo sapiens
  misc_feature: GZ8MTXP02FS2XY.51.82.H05.1.454.CMB.2.raw
  modified_base (242)..(242): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtccgtactgacgcagcccgccctcagtgtctcggggccccagggcagagggtcaccatctcctgcactggaacagttccaacngtcggggacaggttataatgtaacactggtaccagaccaacttccaaggaaccacgaccccccaaactccctacactcccatcgaactaccaagaaactccggaccccgtcggggtcccctcgacccgtattcctacgtcggccttaccgagtcctacgacctaccgttccacgtccctccctcgccctactcacgtcgggcctccgagactagacgagtgaggctagtactagttactacgacctacgtcctatacgacgagacgtgactgacgtgtcgttcggttcgggtttccgggcgggtaccggaccgtaacgcgtacgaccgtccgtacggtacgacgacccgg

SEQ ID NO: 375490 - DNA, 530 bp, Homo sapiens
  misc_feature: GZ8MTXP02I029N.51.82.H05.1.454.CMB.2.raw
  modified_base (182)..(182): a, c, t, g, unknown or other
  modified_base (230)..(230): a, c, t, g, unknown or other
  modified_base (288)..(288): a, c, t, g, unknown or other
  modified_base (332)..(332): a, c, t, g, unknown or other
  modified_base (458)..(458): a, c, t, g, unknown or other
  modified_base (497)..(497): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctnttcttggtggcagcaaccacaggagcccactcccaggtgcagctggtncagtctgggactgaggtgaagagcctggggcctcgagtgaaggtctctgcaagcttcnggatacaccttcaccgactactatatgcacgtgggtcgccgacncggcccctaggacaagggcttggagtggagtgggatggatcgaacctagatggtcgacaacaaactatcgacacgagtacttttacgagggtcgtagggtacacctagtacgaccagacgacaacntactagactaacactacgtctacagtggacgttgaaccngtcctagacccgagacggtccgttagttttacg

SEQ ID NO: 375491 - DNA, 721 bp, Homo sapiens
  misc_feature: GZ8MTXP02J1H70.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggaacagttccaacagtcggggcaggttataatgtacactcggtaccagacaaccttccaaggaaccacgaccccccaaactccctacactccatgactaccagaaactccggaccccgtcgggggtcccccctgaccgtattcctcgtcggacccctagtcttacgacctacttccgacgtccccttcccgtcggaccctaactcccgtaccgttcggggaccccttaccggacgtaaccgttacgggaagggtacgttacgggaaacgggtccgttacggtaacctttaacgtttaccgttaccggtaccctaacggttaccctttaacgacggtaacgaacggtccgaaacggggtccttacggtaaccgttcgggtacggtttcggggtttccgggggttttaccggggcccgggggtacccggggtaaccgaacggtcccgtaccgggtaccccggttaccggttaacggtacccgaaccggtacccccgg

SEQ ID NO: 375492 - DNA, 642 bp, Homo sapiens
  misc_feature: GZ8MTXP02G83VT.51.82.H05.1.454.CMB.2.raw
  modified_base (282)..(282): a, c, t, g, unknown or other
  modified_base (444)..(444): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagccgtggggcctcgagtgaaggtctccgngacaagcttcgtggactacaccttcaccgtactactatatgcacgtggggtgccgacacgggccccctagggaaccgtaaaggggtccttgggaggttggagttggggatgggtactaccgggaaacccttaaaggaagttggggcaccaaactaaaacgtntaggacaactagttaccttttagaacgggtcgtcgggttacaacccgaatcgaacccgagcgaaccaacattacctaagaaccaaaacaacgaacggttacccaactaacttacggggacggtttacgaaacccctaacgtacccgtaccggaaaccggtaacccgaccgggttacccggtttacggttttttaacgg

SEQ ID NO: 375493 - DNA, 547 bp, Homo sapiens
  misc_feature: GZ8MTXP02JZ73W.51.82.H05.1.454.CMB.2.raw
  modified_base (215)..(215): a, c, t, g, unknown or other
  modified_base (228)..(228): a, c, t, g, unknown or other
  modified_base (249)..(249): a, c, t, g, unknown or other
  modified_base (290)..(290): a, c, t, g, unknown or other
  modified_base (331)..(331): a, c, t, g, unknown or other
  modified_base (380)..(380): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgcctcagtgtctgggccccagggcagaggtcaccatcnctgcatgggaacngttcaacatcgggcaggttanaatgtacactgaccagcaactccgagacacgccccaatccnatccatgactaccagaaactccggcccgtcggggtcccccnggaccgtattctctcggcctcgaagtctagactacttcagtccctcccngcccatcacgtgggtcctcccagtacctaggacggtatggacgtactcgtacttaacgttacgtcgacccgtagtccctaagcggacagacgaggctgactcgtcgttcggttcgggttcggcgtacggggaaccaggccgtcgacccgttcgtacggacccaccgg

SEQ ID NO: 375494 - DNA, 653 bp, Homo sapiens
  misc_feature: GZ8MTXP02JM8KL.51.82.H05.1.454.CMB.2.raw
  modified_base (208)..(208): a, c, t, g, unknown or other
  modified_base (328)..(328): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacncccactcccgaggtgcagctggtgcagtcgtgggactggaggtagaaggagccgtggggcctgagtagaaggtctctgacaagtcttcgagactaccaccttacaccgtactactatacngactacggtgggtcgacccgaccgaccggccccgtagggaacgaacggggtcttgggaggtggtaaggtcggggaagtcgggaactacccggaaaccgttaaaggtaacgttagggacgaaccaaaacgtaaacttacgacggacctaacgtacgttacgttttacggacggggttacgttacgggtaccaaacgtacgtacgaaccgacgaccgaacgaacacttaacgaacgaaacccaaactactacggtacctaaagtagtacgggtaacgtaccgacctaacgccgtaacgaccgtaccgtaccgttcggttattttacg

SEQ ID NO: 375495 - DNA, 708 bp, Homo sapiens
  misc_feature: GZ8MTXP02HV2CQ.51.82.H05.1.454.CMB.2.raw
  modified_base (263)..(263): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacgaggtcctgggcccagtctgtactgacgcacgcccgccctcagtgtcgtcgggccccagggccagaggtcaccatctctgcacgtggaactgtaccaagtgtccggataggttanaatgacagtcggtaccagactactccgaagacctacgacccccaaatcctacactcatacactaaccagtaacctccccgggacccgtaccggggtccctacggtacccgttattccgtcgtcggtacccttacgaaccgttctaacgacctttacctcctaaccgtccccgtacccgtcggccctaaaccttcgtacccggttccgggtacccttcccggaaaacgtccggttaaggaaacgggttaccgttagggaacggttccgttaaaccggtaaaccgttacttaccgtaccgtacccgttaaccgttacccgttaagtaccggaaccgtacggacccgaaggggttccctagggtaacccttcggttcggttacggtttacggggttccgggtacccggacggtaaaccgacgttccggaacccggttccgttaaccgg

SEQ ID NO: 375496 - DNA, 589 bp, Homo sapiens
  misc_feature: GZ8MTXP02G0KWO.51.82.H05.1.454.CMB.2.raw
  modified_base (207)..(207): a, c, t, g, unknown or other
  modified_base (333)..(333): a, c, t, g, unknown or other
  modified_base (489)..(489): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggancccactcccaggtgcagctggtgcagtcgtgggactgaggtgaagagccgtggggcctgagtgaaggtctcctgacaagacttgtggatactacccttcaccgtactactatatgcacgtggggtnacccgacgaccggccccgtaggacgaacgggtcttggaagtgggagtggggagtgggactccggaaaccctaaggtaaacgtgggtacgacccaaacgaaaactgtacgaccaacgtagttaccgttttacggaggggtcgtgggtaccaacgtanccgaaccagccgacactatacgagacctaaacactagtacctaagagttacggacttacgacaacgtccgacggacccgacgaccggttccgtagttttg

SEQ ID NO: 375497 - DNA, 645 bp, Homo sapiens
  misc_feature: GZ8MTXP02JASY2.51.82.H05.1.454.CMB.2.raw
  modified_base (262)..(262): a, c, t, g, unknown or other
  modified_base (269)..(269): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtcgtcggggccccagggcaggagggtcaccatctcctgcacgtgggaacagttaccaacagtcggggctaggttanatgtacnctggtaccagcaacttccaggaaccacgacccccaaatcctacatccatacgactaccaaagaactccgggacccgtcggggtccccctaggaccctattccgctacggctccgtaaagtctacgactacttcgacgtccctcccgtcggaccctactaccgacgtcgggtcctccgaacgtacgtacggacgtagttacgggaacggtcgttacggtaacttaacgtttacgacgtaccgtaccggttacctaagtcgaccgtaacggcgtaacggtcgtacggtacctgggtaccgttggggtttcggggttttaccgggcgggttacgggaacgtacgcggtacggtaccgtccgttacgggtaccaaccggg

SEQ ID NO: 375498 - DNA, 631 bp, Homo sapiens
  misc_feature: GZ8MTXP02G4590.51.82.H05.1.454.CMB.2.raw
  modified_base (200)..(200): a, c, t, g, unknown or other
  modified_base (205)..(205): a, c, t, g, unknown or other
  modified_base (219)..(219): a, c, t, g, unknown or other
  modified_base (228)..(228): a, c, t, g, unknown or other
  modified_base (336)..(336): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtgcagcaaccanaggancccactcccaggtncagctggtncagtctggggactggaggtgaagaagccgtggggcctcgagtgaaggtctcctgacaagtacttctaggactacaccttcaccgactactatatcgacacgtggggtncccgacacggccccgtaggacaagggcttggagtggagtgggatggactacgaacctaagtaacgtggtacgaccaaactaaacgtacgtacgactaaccgtacgttacgtttttaccggacggggttccggttacggggttacccaacccgaagttaccggaaacccgacggaccgaaaccacgtaacttaccgtaaacgaacctaaaacgaactacgtactaaacgtagtacggtacgttacgaaccgtaacgccgtacggaacccgacgtaccggtccgtttagttttacgg

SEQ ID NO: 375499 - DNA, 608 bp, Homo sapiens
  misc_feature: GZ8MTXP02JA26D.51.82.H05.1.454.CMB.2.raw
  modified_base (208)..(208): a, c, t, g, unknown or other
  modified_base (258)..(258): a, c, t, g, unknown or other
  modified_base (332)..(332): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacncccactcccaggtgcagctggtgcagtctgggactgaggtgaagagccgnggggcctgagtgaaggtcctctgcaagtcttcgtggataccaccttcaccgacttactatatgctacgtgggtnccgacacggtcccctagggacagggtcttggagtggatggggatgggataccgaaccgtaaagaagtggtcgacccaactaaacgtatacggactacgagttaccgttttacgacggggtccgtacggggttaccaacccgtagttccgaaccaggaccgtaaccgaactacttaccgaaagacctaaaacactacgtacctatacgttaggacgttacgaaccgtaacgtccctaacggacccggaccgtacggtaccggtttacgtttttaagg

SEQ ID NO: 375500 - DNA, 697 bp, Homo sapiens
  misc_feature: GZ8MTXP02I5TBK.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgcctcagtgtcgtcgggccccaggcaggacgggtcaccatctcctgcacgtaggaacagttaccaacgagtcgggctaggttataatgtacacgtggtaaccagcctaacttccgaaggaaccacgaccccctaaatccctacactccatacgaactaccaagaaactccggcccgtccggggtcccctcgaccgtacttcctcgtacggtccctccgtaaacgtccgtacgaacctaccgtttacaaccgtcccctcccgtaccggtacccctaacgtcccgtaaccggtccggggtaccctacccggtacggtaacgttacggaaacgggtacgtacgggtaacggtcgttaacggttaaacctttacgttacgttacccgtaccgtaccggttaccctaagtacgtaccgacgacgtacggtaccgtgtaccgtggtacgttcgggtttcgggtttaccggccgggtaccggtaaccgtaagtccggtacgaccgtaccgttacgggacctaacccgg

SEQ ID NO: 375501 - DNA, 697 bp, Homo sapiens
  misc_feature: GZ8MTXP02FP4NM.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtcgtcgtcggggccccagggcagagggtcaccatctcctgcacgtgggaacagttccaacagtcgggcaaggttataatgtacacgtggtaccagactaacttccgaaggaaccaccgtacccccaaactccctacacgtccatgactaaccgaagtaaacgtcccggacccggttcggggtcccccctagtacccgactttccgtcgtccggccttacccgaagtctcgacctaccttacgaccgtcccctacccgtcggtaccctagtcccgtacggttcgggaccctacccgtagtaaccgtggaaacgttgtacggaacgtcgtaacggtacttaaacgtttcgtacgtaccctacggtttaccctagtacgaacgacgtcgaaacggttcgtaacgacgttcgtaccggtttgggtttcgggttttacccggggacggttacccgggggaaacttaaccggacgtttcccgggaaccgtaccggttaaaccgggtccaaaaccccggg

SEQ ID NO: 375502 - DNA, 618 bp, Homo sapiens
  misc_feature: GZ8MTXP02HGWZO.51.82.H05.1.454.CMB.2.raw
  modified_base (230)..(230): a, c, t, g, unknown or other
  modified_base (332)..(332): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttctggtggcagcaaccacaggagccccactcccaggtgcagctggtncagtctgggactgaggtgaagagcgtgggctcgagtgaagtctcctgacaagtcttctggactaccgtaccttcaccgactaactatatgctacgtggggtnacccgacaccggcccctagggaacgaagggtcgttggaggttaggagtacgggggagtagggactacccggtaaaccctaaaggaacgtttacgggcgaaccctaaaacgtaaactacgtacgtaacaaccgtagttaacgttttacggagggggtcgttacggggtaccacgagtacgaaccgacgacgtacacattacgacgaaccctaaacgactacgtactaacgacgtggtacgtacgaccgaagcccgtacgaacccgacgtacggtcgttaggttttag

SEQ ID NO: 375503 - DNA, 634 bp, Homo sapiens
  misc_feature: GZ8MTXP02HV16L.51.82.H05.1.454.CMB.2.raw
  modified_base (181)..(181): a, c, t, g, unknown or other
  modified_base (201)..(201): a, c, t, g, unknown or other
  modified_base (207)..(207): a, c, t, g, unknown or other
  modified_base (222)..(222): a, c, t, g, unknown or other
  modified_base (262)..(262): a, c, t, g, unknown or other
  modified_base (292)..(292): a, c, t, g, unknown or other
  modified_base (330)..(330): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctnttcttggtggcagcaaccanaggacncccacgtcccgggtncagcgtggtgctagtctgggactggaggtagaagagccgngggcctagagtgaagtcctctgacaagctngtactacaccttacacgtactactatatgcacgtgggnaccgtaccgacggcccccgtaggaaccgtaggtcttaggacggttggagtggggactaggggactaccgtaaacccgtaaagtaaacgttggacgaaccaacgtaaaacttatacgaacacgtaacgttacgtttacgaagggtccgttaacgggtacctaacgagtacgaacccgaaggaccctaaccagtaacgttacaaacgaaccaaactacgaactacctacgaagttacggtagtaccgaaccgtacgaaccgtacggaacccgtacggtaccggtaaccgtttgtttaacgtttcgg

SEQ ID NO: 375504 - DNA, 649 bp, Homo sapiens
  misc_feature: GZ8MTXP02GA68K.51.82.H05.1.454.CMB.2.raw
  modified_base (228)..(228): a, c, t, g, unknown or other
  modified_base (245)..(245): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgccctcagtgtcgtggggccccagggcagagggtcaccatctcctgcacgngggttaacagttccaanagtcggggcaggttataatgtacactggtaccagcaactccagaacacgacccccaaatccacactccatagataccaagaaactccggcccgtcggggtccccctgaccgtatctctcgctccgaagtctcgactcttacacgtccctacccgtcggaccctagtccgacgttcgggtaccctacccgagtaccgttaggagggagttacgggaggtccttaggtaaacctttacgttaacgtacggttaccccaacggtttaccctaagttacgaacgtacgcgaacggtcgtagttaccgttggcgtttacgggttcggggtttttccggggaccgggttaccggggaacctaacgggtccgtaccgtacccgggttccgttaacggggtacctaaccggg

SEQ ID NO: 375505 - DNA, 734 bp, Homo sapiens
  misc_feature: GZ8MTXP02IC58I.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgcctcagttgtcgtcggggccccagggcaggagggtcacatcctctgctacgtgggaacagttaccaactagtccggggactaggttaataagtaggtaccacgttacggtaccagactaaccttacccgaaggaaaccaccgacccccctaaactccctacactacccatacgactaaccaagtaaaccgtcccggtaccccgttcgggggtaccccctacggaacccgttctcctcgtcggaccctttaccgaaacgttcctaccgaaccttaccgttacccgaccttcccccgtccccgttcggacccttaacctccgtaacccggtcggggtacccttacccggaaacgtttacccgtaagggtaaaccgggtacggtacggacggttacgtacgttaaccgtttacttaccgtaccgtaccgtacgttacgtagtacgacgtacgacgtacgtacgtacgtcgtcgttacggtttcgggttcgggttaccggggacgggtaccggaaccgtacggtccgtaccggtaccgttaccggtacggtaccgaccgg

SEQ ID NO: 375506 - DNA, 745 bp, Homo sapiens
  misc_feature: GZ8MTXP02F06JP.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgcccgccctcagtcgtcgtcggggccccagggcaggacgggtccaccatcctcctgccacgtagggaactagttaccaacacggtcgggactaaggttataatgtacacgtaggtaccagacctaactccgaaggaaccaccgacccccaaactccacactccatacgaactaccgaagaaaccgtccggccccggttcggggtcccccctacggacccgtatttccgtcgtaccggtacctccgaacgttctacgtaccctacctttcgacccgtccccttacccgtacggtaccctacgtacccgtaccggttccggggtacccttacccgaacggtaaccgttacgggaaagggtacgttacggggtaaacggtccgttaaccggtacgtttaactttacgtaccggtacccttaggttaccctacgtacgaccgtaaggccgtaacggtccgtaaggtccgttcgttcggtttacgggtttccggggtttaccgggccggggtaaccggtaaccgtaacggtccgttaccgggtacccgttacggtaccgggtaccgtaaccccggg

SEQ ID NO: 375507 - DNA, 712 bp, Homo sapiens
  misc_feature: GZ8MTXP02JOM0K.51.82.H05.1.454.CMB.2.raw
  modified_base (262)..(262): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacgagggtcctgggcccagtctgtactgacgcacgccgccctcagtcgtcgtcggggccccgagggcaggacgggtcaaccatctcctgcacgtagggaacctacgttaccaacgnggtcgggactaaggttaataagtcgtacacgtacggtaccagacctaactaccgaagaaccaccgacccctaaactccacactaccatacgaaactaaccgaaagtaaccgtcccccggggtaccccggttaccgggggttacccctacgtaacccggttactttccgtccgtacggtaccctaacccgtaaacgttccgtacgtaacctaccttccgacccgtcccctacccgtcgtaccctacgtcaccggtcggaccctacgacgacgtaggagtagacggtgtactagttactactacgccgtactacgttacctagacgaacgtcggacccgtagggtcctaaggtacgttcggttcgggtttacggtttccgggggtttccggggaccggtaaaccggggttaaccgacggtcccggtaaacccggtcccggtttaaacccggg

SEQ ID NO: 375508 - DNA, 663 bp, Homo sapiens
  misc_feature: GZ8MTXP02H85XS.51.82.H05.1.454.CMB.2.raw
  modified_base (559)..(559): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacgagggtcctgggcccagtctgtactgacgcacgcccgccctcgagtcggtccgtcgggggcccccagggcaggacgggtccacactcctcctgctacgtagggaactacgttaccaacgaggtcggggactaggttataagttcgtaactacgtcggtaccagacctaaccgttaccgaaggaacccaccgacccccctaaactccctacactaccagtacgaactaaccgaagtaaacgtccccggggtaccccggttccgggggtaccccctacggtaaccccgtctttccgtcgtacggtcccttaccgtaaagttcctaccgaccttaccgttccaccgtcccctcccgtcgccctacgtccgacgtcggacctcgagacgtaggcgaagtggagtctagtacttacgtacncgtacctacgtacctatacggacacgcgtacgtcgtgtaccgtgtcgttcggtttcgggttccggcggacgaacacgtcgtacgaccgttcgaggtaccaccgg

SEQ ID NO: 375509 - DNA, 681 bp, Homo sapiens
  misc_feature: GZ8MTXP02I94ZW.51.82.H05.1.454.CMB.2.raw
  modified_base (397)..(397): a, c, t, g, unknown or other
  modified_base (434)..(434): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgcccgccctcagtgtccgtcggggccccagggcaggaggtcaccatctcctgcacgtgggaactacgttaccaacaggtcggggctaaggttaatatcgtactacgtacggtaccagacctaaccttaccgaaggaaccaccgaccccccaaaatccctacactccatacgaactaaccaacgtaaacgtccgggcccggtccggggtacccctcgaaccgtnttcctcgtcggtcctccgaagtctacgacctcttacnccgtccctcccgtcgcctacgcctacgtcggcctccgaacgtacgtggaggtagtcggacggtactacgtacgttacttaccgtacgtcccgtacggttaccctagtcgaacgaacgcgtaacggtacgtacgtcgttaccggtggttcgggggtttacgggtttcccggggaccggggtaccggaaccggtaacggttccggaccggttaacccgtacccggtttaacggacccgtaaaccccggg

SEQ ID NO: 375510 - DNA, 599 bp, Homo sapiens
  misc_feature: GZ8MTXP02JJ1RW.51.82.H05.1.454.CMB.2.raw
  modified_base (231)..(231): a, c, t, g, unknown or other
  modified_base (292)..(292): a, c, t, g, unknown or other
  modified_base (334)..(334): a, c, t, g, unknown or other
  modified_base (495)..(495): a, c, t, g, unknown or other
tcagcgatcgtatacacgaccggtgctcgatttagtcgagctctctcgcgggcacgaccggtgctcgatttagtcgagctctcaaagagaaagggggagcatcacccagcaaccacatctgtcctctagagaatcccctgagagctccgttcctcaccatggactggacctggaggatcctcttcttggtggcagcaaccacaggagccccactcccaggtgcagctggtncagtctgggactgaggtgaagagccgtggggcctcgagtggaaggtctcctgcaagcttcnggatacgaccttcaccgtactactatatgctacgtggggtcncgaccgacgccccgtggacgagggcttggagtggagtgggatgggactcgaacctaagagtcggtcgaccaactaaactagtcgacaacgtagttacgtttcggacgggttcgtacgggtacacccgattacggaaccgagaccgaaccacgacttacganaccaacaacgacgtacctaacgtagtacgggtacgttaccgaccaacggcccgtaacggaccccgacggaacccgggttccgtttacgggtttatttttagggg

SEQ ID NO: 375511 - DNA, 595 bp, Homo sapiens
  misc_feature: GZ8MTXP02IG93R.51.82.H05.1.454.CMB.2.raw
  modified_base (264)..(264): a, c, t, g, unknown or other
  modified_base (334)..(334): a, c, t, g, unknown or other
  modified_base (405)..(405): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaaccacaggagcccactcccaggtgcagctggtgcagtctgggactgaggtgaagagcgtgggcctnagtgaaggtctcctgacaaagacttcgtaggatacaccttcaaccgactaactatatgactacgtgggtnaccgacgacgcccctggaacaaagggcttggagtggatgggatggatcgaacctaagaagtgagaccaaanaaaactatgacaacgtagtaccgttttagaacggggtcgttaggggtaccaacctagtacaccgaacggtaccgaaacacaacttacctaaagacaaaacgtaaccaagttacctaaacgtaagtacggtacgttacgaaccgtaacgacccgtacggaacccgtaaccgaccggtaccgtttagtttag

SEQ ID NO: 375512 - DNA, 640 bp, Homo sapiens
  misc_feature: GZ8MTXP02GO9Z9.51.82.H05.1.454.CMB.2.raw
  modified_base (208)..(208): a, c, t, g, unknown or other
  modified_base (297)..(297): a, c, t, g, unknown or other
  modified_base (374)..(374): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacnccccactcccgaggtgcagctggtgcagtctgggactgaggtgaagagccgtggggcctcgaggtgaggtctcctgacaagtacttcgnggatacaccttcaccgtactactatatgcacgtggtcgacccgacgacggccccctaggacgaacgggtcttagggngtagggtagtaggggattcgggaagttacccgtaaacccgtaaagtaacgtgggtacgacccaaactaaaactacgtagacctaacgtacgttacgtttacgaacgggtccgttacggggtaccaaccgtaacgacgaaacccgacggacctaaacgaacctactacgtaacgacaaaaccgactaaggtactaaacgtagtacggtacgttacggaactaaccggactaccggaaccgaccgtaccggtccgttaacgttttcgg

SEQ ID NO: 375513 - DNA, 628 bp, Homo sapiens
  misc_feature: GZ8MTXP02G0I6E.51.82.H05.1.454.CMB.2.raw
  modified_base (98)..(98): a, c, t, g, unknown or other
  modified_base (180)..(180): a, c, t, g, unknown or other
  modified_base (200)..(200): a, c, t, g, unknown or other
  modified_base (229)..(229): a, c, t, g, unknown or other
  modified_base (294)..(294): a, c, t, g, unknown or other
tcagcgatcgtatacacgaccggtgctcgatttagtcgagctctctcgcgggcacgaccggtgctcgatttagtcgagctctcagagagaaaggggancatcacccagcaaccacatctgtcctctagagaatcccctgagagctccgttcctcaccatggactggacctggagatcctnttcttggtggcagcaaccanaggacgcccactcccaggtgcagctggtncagtcgtgggactgaggtgaagagccgtggggcctcgagtgaaggtctcgtgacaagtacttcgnggatacctaccttcgaaccgtactactatatcgactacgtggggtcgacccgacaccggtcccctaggacgaaggtcttgggagtggagtgggatacgggactacccgaaaccgtaagtaaagttcggacgacccaaaagtaaaactgacgtaacactaagttaccctttaaggcgggtacgttacgggtaccaaccgttagaccgaaccgaggccgtaaccgtaactacttacgaagacctaaaacacgttaacgtacgttaaccagtacggtaacgttcgaaccgtcgaccgtacgaaccgaccgaccggttaccggtttagttttaacggg

SEQ ID NO: 375514 - DNA, 647 bp, Homo sapiens
  misc_feature: GZ8MTXP02GEXRG.51.82.H05.1.454.CMB.2.raw
  modified_base (190)..(190): a, c, t, g, unknown or other
  modified_base (453)..(453): a, c, t, g, unknown or other
  modified_base (489)..(489): a, c, t, g, unknown or other
  modified_base (517)..(517): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacgagggtcctgggcccagtctgtactgacgcacgcccgccctnagtgtcgtcggggccccagggcaggaggtcaccgatcctctgctacgtacgggaactcgttaccaacgtacggtcgggactaaggttaataacgtgtacctacgtcggaaccagaccctaaacttaccgaaacggaacctaccccggaacccccctaaaatcccgtacacctacgagttaccgaacttaaaccgaaggtaaccgtcccccgggtccccgggtaccggggtcctacgaccgtcttcgtcgtcgcctacgatccngaacctacttcaccgtccctaccgcgaccacgtacncgtcggcctacgacgtcgtagggacgtntacggagtcgtagtactaccttacggcaccgtaacttccaatacgacaggtcgaacggttcgtaacgttcgtcgttaccggttggtttaccgggtcgaccgggtacgacagtccgtacggtcccgtaacg

SEQ ID NO: 375515 - DNA, 584 bp, Homo sapiens
  misc_feature: GZ8MTXP02F6S7Z.51.82.H05.1.454.CMB.2.raw
  modified_base (208)..(208): a, c, t, g, unknown or other
  modified_base (277)..(277): a, c, t, g, unknown or other
  modified_base (288)..(288): a, c, t, g, unknown or other
  modified_base (327)..(327): a, c, t, g, unknown or other
  modified_base (374)..(374): a, c, t, g, unknown or other
  modified_base (393)..(393): a, c, t, g, unknown or other
  modified_base (404)..(404): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacncccactcccaggtgcagctggtgcagtctgggactgaggtgaagagccgtgggcctcagtgaggtctcngcaagcttcgngactacaccttcaccgtactactatatgcacgtgggtcnccgacgacggcccctggacaagggtctgagtggagtgggataggacncgaacctagaagtggtacnccgaataactntgacactagtactttcgagggtcgtacggtaccaccgagtacgaaccgagaccgaacgactaagttcctaaacgacctaacaacacggttactaaacgagtttacgggtaacgttcgaaacccgttgaacccgtacggaaaccccggtaacgtaccccgggtacgtttaggtttttaagg

SEQ ID NO: 375516 - DNA, 624 bp, Homo sapiens
  misc_feature: GZ8MTXP02F3Q9Y.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacgaggacgccccactcccaggtgcagcgtggtgctagtcgtgggactggaggtgaagagccgtgggcctgagtgagtctcgtgacaagtactcgtggactacctacccttcgaacccgtaacttaactatagtcgactacggtgggtcgacccgacgaccggcccgtaggacgaaggtcttggagtggtagtagggagtaggactaccgaaaccgtaaagtaagtcggtacgaccctaaacgtaaactagtacgacctaacgtaacgtacgtttacggacgggtacgtacgggtacaccgaagtacgaacccaggaccaacaacgtatacgtacgaaccaactacgtagtaccaagtagtacggtaacgtcgaaccgtaacgccgtacggaaccgaccggtaccggtaccgtttgtttaacgg

SEQ ID NO: 375517 - DNA, 670 bp, Homo sapiens
  misc_feature: GZ8MTXP02F62UZ.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcggggccccagggcaaagggtcaccatctcctgcacgtggaactagttccaacgagtcggggactaaggttataatgtacacgtcggtaccagacctaaccttccgaacggaaccaccgacccccaaactcctcaactccatcgaactaccaagtaaactccggacccggtccggggtccctagacccgtcttctcgtcggacctcctacgtctcgaacctaccgttcaccgtcccttcccgtacgaccctaactcccgtaccgttcgggcccttacccgaggtaccgtggaacggtagtcggacggtcctagtaacgttacttaacgttccgaccctacgttacctaagtcgaacgacgtaacgacggtaccgttagccgttgttccggttaggggtttccggggttttcccgggaacggggccggtaaaccgaacggtccgtacggtacccgtaccgtacggtccgaacgaccccgg

SEQ ID NO: 375518 - DNA, 589 bp, Homo sapiens
  misc_feature: GZ8MTXP02HK0LH.51.82.H05.1.454.CMB.2.raw
  modified_base (260)..(260): a, c, t, g, unknown or other
  modified_base (296)..(296): a, c, t, g, unknown or other
  modified_base (377)..(377): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtcgcagctggtgcaggtctgggactgaggtgaaagaagccnggggcctcgagtgaggtccactgacaagtacttcgnggataccaccttcaccgaactactatatgctacgtgggtcaccgaccaggccccctagggacccaaggggtccttaggggngtaggaggtgggagtaggactacccgaaccgtaagaagtggacactaacaactagtacgacgactacgttacgtttacggacggtacgtacggtacacgacgtacgaccagacacctacactactacactaacagtacgtactaacgtacgtacggtacgtacgaccgaacgccgtacggacccgtaccgtccggttaccgtttagtttacg

SEQ ID NO: 375519 - DNA, 729 bp, Homo sapiens
  misc_feature: GZ8MTXP02G0RRZ.51.82.H05.1.454.CMB.2.raw
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacgagggtcctgggcccagtctgtactgacgcacgcccgccctcagtgtccgtcggggccccagggcaggaggtcaccatctcctgcacgtagggaactacgttaccaacgtacggtcggggactaaggttaataagtcgtaacacgtacggtaccagacctaaccgtaccgaacggaaccaccgacccccaaactccctacactaccaagtacgtaactaaccgaaagaaaccgttcccgggtaccccggttaccgggggtaccccctacggtaacccgtacgtttccgtacggtccgtacctaccgtaaacgttctaccgtaccttaccgttacgaccgtacccccttccgtacgaccctacgtccgaccggttccggtaccctaccgtaacggacgtacgggaacggtacgtacgggtacgtacgtaaggttaaccttaacgttacgtccgtaacccgtacttccgtagtacgaccgtacgacgtaacggtcgtacgtacgttcgtcggtttcgggttcgggttaccgggacgggtaccgaacgtacgaccgttacggtacccgtacgtaccggtacgaacccgg

SEQ ID NO: 375520 - DNA, 622 bp, Homo sapiens
  misc_feature: GZ8MTXP02HQRPF.51.82.H05.1.454.CMB.2.raw
  modified_base (231)..(231): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtncagtcgtgggactggaggtgaagagccgtggggcctgaggtgaaggtctccgtgacaagtcttcgtaggactaccgtaccttcaaccgtactactatatgctacgtggggtcacccggacgaccggccccctaggggaacgaacggggtcttgggaggttggagtggggagtggactccgaactaaagagttggacgaccaaataaactgtacgactaacgtagttacgttttcggaagggtcgttacgggtaccaaccgtataccgaacacggactaacacattacgaagacctaaaacacgtaagttacaaacgtagttacgggtacttacggaaccaacggaccgtaaccggacccgaacggtacccggtccgtttacgtttttacgg

SEQ ID NO: 375521 - DNA, 689 bp, Homo sapiens
  misc_feature: GZ8MTXP02F926W.51.82.H05.1.454.CMB.2.raw
  modified_base (189)..(189): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacgagggtcctgggcccagtctgtactgacgcacgccgccctnagtcgtcgtcggggccccagggcaggacggtccacctatcctcctgctacgtaggggaacacgttaccaacgtacggtcggggactaaggttaataagtcgtaactacgtacggtaaccagcctaaacctccgaacggtaaaccaccgaaccccctaaaactcctacaactccacttacgaactaacgaacgtaaacgtcccccggtacccggtccggggtccctacggtaaccgtacgttcctcgtcggaccttaccgtaaacgttccgtactaaccttccgttaccaccgtcccctacccgtcgacctacttacgaccggttcgggcctaccgaagtacgttacggacgtaagttcggacggtcctacggtaacttacttacgtcggtacctaagttccttaagcgaaaccgtcgacgtaggcgtacgtacgtcgttacggttcggttacgggtccgggacggaacggtaccgacggtaccgtaccggtacccgtacg

SEQ ID NO: 375522 - DNA, 628 bp, Homo sapiens
  misc_feature: GZ8MTXP02IFXOP.51.82.H05.1.454.CMB.2.raw
  modified_base (184)..(184): a, c, t, g, unknown or other
  modified_base (204)..(204): a, c, t, g, unknown or other
  modified_base (210)..(210): a, c, t, g, unknown or other
  modified_base (224)..(224): a, c, t, g, unknown or other
  modified_base (233)..(233): a, c, t, g, unknown or other
  modified_base (239)..(239): a, c, t, g, unknown or other
  modified_base (265)..(265): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagcctccgttcctcaccatggactggacctggaggactcctnttcgtggtggcagcaaccanaggacncccatcccaggtcncagctggtncagtcnggactgaggtgagagcgtgggcctgngtgacggtcactgacaagtctgtaggactaccgtacttcaaccgacttaacctatatcgaccacgtgggtcgcccgacgaccggccctaggacgaaacgggtcttgggagtacggggagttagggggagtacgggttacacccggtaaaacccgtagaaaggttcggaccggaacctaaaacggtaaaacttgtacggaactaaccggtagttaccgtttaggacgggtaacgtcgggtactaaccgacgacgaccgaggacacttaaccgattcaagacccaaacacgtctacgtacgacgtacgtacgtacgaaccgaacgtacccgaacggacctacggtaccggttacgttagtttacg

SEQ ID NO: 375523 - DNA, 753 bp, Homo sapiens
  misc_feature: GZ8MTXP02J1OVT.51.82.H05.1.454.CMB.2.raw
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagactcctcttcgttggtggcagaccaaccacgaggacgcccactcccgaggtcgcagcgtggtcgcagtcgtgggactggaggtgaagacgccgtggggccctagaggtagaacggttcctccgtgacaaggtacttcgtggactacctaccttcaaccgtactactatatgacctacggtgggtacacccgtaccgccggtcccccgtagggaacgaacggggttctttgggagggtacgggtagttagggggatacgggtaactacccggaaacccttaaaggaacgtttgggaaccgaccctaaaactaaacgtacgtacggaacctaacgtacgtttaccgtttacggaggggttccgttacggggtaccaaccggtacgttaccggaacccgacgggtaacccaaccgtaactaaccgtttacgtaaaaccggaaccctaaaaccggtaaccctaaacggttacctaaaccggttaggttacggggttaaccgttaccgtaaaccccgaacggttacccgaaccgggtaacccgtaacccggtacccggtttaccggtttaggttttttaacgg

SEQ ID NO: 375524 - DNA, 623 bp, Homo sapiens
  misc_feature: GZ8MTXP02FGE5I.51.82.H05.1.454.CMB.2.raw
  modified_base (272)..(272): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctggggactggaggtgaagaagccgtggggcctcgagngaaggtctcctgacaagtacttcgtggactacaccttcaccgtactactatatgcagtgggtcgcccgacgacggccctggaacaagggcttggacgtggagtggggatggactaccggaaaccctaagtaaagtcgggtacgaccgaaactaaacgtactacggaacctacgaaacgttaccgttttacggaacggggtccgttcggggtaccaaccgtacgtacgaacccgaggaccgaacgaactactacgtaacgaacaaactacgtacgtactaacgagtacggtaacgtacgaaccgtaacgcccgttacggaacccgacgtaccgggtccgtttagttttaacg

SEQ ID NO: 375525 - DNA, 689 bp, Homo sapiens
  misc_feature: GZ8MTXP02FHITJ.51.82.H05.1.454.CMB.2.raw
  modified_base (258)..(258): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagagggtcaccatctcctgcactgggaacagttccaacagtcggggcaggttataangtacacgtggtacagacaacttccacggaacacgacccccaactccctacactccatcgactaccacgaaactccggtaccccgtccgggggtcccccctcggacccgtattctcgtcggtccttcccaaacgtctagacctacttcacgcccttacccgtcggccctaactcaaccgtggggtcccaccgtaacggaaccgttgggtaacggacgttagggaacgggctacggtaacttactttaaccgtccgaacccgtcggtaccccttaattacggaaccgacgtaccgaacggcccgttaacgacccgttggtcccggttaggttttacccgggggttttacgggcccggggttaccgggggtaaccccaaaaggggtcctaccgggtacccggttacccgttaacgggtcccgaaacccccgggg

SEQ ID NO: 375526 - DNA, 752 bp, Homo sapiens
  misc_feature: GZ8MTXP02H217F.51.82.H05.1.454.CMB.2.raw
  modified_base (190)..(190): a, c, t, g, unknown or other
  modified_base (311)..(311): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttggnggcagcaaccacaggacgcccactcccgaggtgcagcgtgggtgcgagtcgtgggactggaggtagaaggagccgtcggggcctcgaggtagaaggtcctccgtgactaagtacctttcgnggtactaccgtaccttaccgaaccgtactactattagtcgaccgtacgtggggtacacccggtaccgaccgggtacccccgtaggggaaaccgtaacggggtccttggggagggttaggaacggttagggggaacgtcgggggtaaactacccgggtaaaaccccgttaaaaggacggttacgggtaccggaaaccctaaaaccgtaaaacgttacgtacggtaacctaaaccgttacgtttaacccgttttacggggaacggggttccggttacgggggttacccaaacccgtacggtaaccggaaccgaaccggaccgaaccgtaacgtactacgtaacgaaccaactaaacgtacgttaacctacgtaggtacggtacgttaccgaccgaacggtccgtacggaccccggacgtacccgggtacgttttacgtttagg

SEQ ID NO: 375527 - DNA, 634 bp, Homo sapiens
  misc_feature: GZ8MTXP02FHQRQ.51.82.H05.1.454.CMB.2.raw
  modified_base (218)..(218): a, c, t, g, unknown or other
  modified_base (227)..(227): a, c, t, g, unknown or other
  modified_base (347)..(347): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatctcttctggtgcagcaaccacaggagcccactcccaggtncagctggtncagtctgggactgaggtgagagcgtggggctcagtgaaggtctcctgacaagcttcgtaggactacaccttcaccgtactactatatgcacgtggtgccgacacggccctggacgaaggngttcgagtggacttggggatggaacttccggaaccctaaaggaagtacggtagacccgaaactaaaaccgtatacggaaccaacgtaaacgtacgtttttaccgacggggtacgtacggggttaccaacccgtaagtacgaacccgaagacccgaacaaccgtataccgtacgacctaaaaccaacgacgtacctaaaccaaggtttacgggaacgtttacgaaccgaacgtacccgttaacgtaaccccggaaccggtaccgggtacccgttaggtttttaaccgg

SEQ ID NO: 375528 - DNA, 623 bp, Homo sapiens
  misc_feature: GZ8MTXP02GINYM.51.82.H05.1.454.CMB.2.raw
  modified_base (446)..(446): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcacgccgccctcagtgtccgtcggggcccccagggccaggacgggtccaccatcctccgtgcacgtgggaacctacgttaccaacagtcggggactaggttataagtgtacacgtcggtaccagctaactcgaggaaccacgaccccaaactcctcactccatcgactacgagaaactccggccccgtcggggtcccctgaccgtatctcgtcgacctccaagtctagacctactcacgtccctacccgtcggccctataccgacgtcggtcccnccgacgtacgtcggagtgtacggacggccttaggtaccttaagttcctcggacccttagtaccctagtcggaacaggacgtaacgcgtagtcctcggtcggttacggtttcgggttccgggacgggtacggtaaccgtacgacgtaccggtaacccgtcggtacggcgtaaccccgg

SEQ ID NO: 375529 - DNA, 636 bp, Homo sapiens
  misc_feature: GZ8MTXP02IXZY2.51.82.H05.1.454.CMB.2.raw
  modified_base (182)..(182): a, c, t, g, unknown or other
  modified_base (426)..(426): a, c, t, g, unknown or other
tcagcgatcgtatacacgaccggtgctcgatttagtcgagctctctcgcgggggcttcagctttgggcacaagaggcagcactcaggacaatctccagcatggcctggtctcctctcctcctcactctcctcgctcactgcacagggtcctgggcccagtctgtactgacgcagccgccctnagtgtcgtggggccccagggcagagggtcaccatctctgcactggaacagttccaacagtcgggcaggttataatgtacactggtaccagcaacttccaggaacacgaccccaaactccacactccatgactaccagaaactccggcccgtcggggtccctacggaccgtattctcgtggcctcagtctgacctactcacgcctcctgccacgtcacgtcggcctccgacgactacggtagagnggtacggtctaggtaccttagttaaccgtcggtaccctacggttacctagttcgaaaccgaggtacgaacggtcgttacgaccgttggtccggtttgggttcggggtttttaccggggcccggggtacccggggaaacccgtaacgggtcccggttaccggtaaccccggttcccggttaaccggttaccggaacccggttaacccccgg

SEQ ID NO: 375530 - DNA, 689 bp, Homo sapiens
  misc_feature: GZ8MTXP02JHUI0.51.82.H05.1.454.CMB.2.raw
  modified_base (266)..(266): a, c, t, g, unknown or other
  modified_base (288)..(288): a, c, t, g, unknown or other
  modified_base (328)..(328): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggagatcctcttcttggtggcagcaaccacgaggagccccactcccgaggtgcagctggtgcgagtcgtgggactgaggtagagagctgggcctnagtgagtctctgacaagtactntggatactaccttcaccgactactatatgctacgtgggtnccgacgacggccctggacgaaggtcttggaggtgggagtggggatagggactaccggtaacccgtaagaacgttgggtacgaccctaaacaaacgttgtacgaccgactaaggttaccgtttacggacggggttcgtcggggttaccaaccgtacgttaccgaacccgacggtaaccgaccgaaacgtacttacgtaaacgaaccgaaaacccgtaactaacgggttaaccccttaaacggaaacgggtttaaggggtaaaccgtttaccgggaaacccgaacccgggttaacccgtaccgggaaacccccggttaaccggaaaaccccggggtttcccgtttagggttttttaaaccggg

SEQ ID NO: 375531 - DNA, 560 bp, Homo sapiens
  misc_feature: GZ8MTXP02JDAAD.51.82.H05.1.454.CMB.2.raw
  modified_base (99)..(99): a, c, t, g, unknown or other
  modified_base (181)..(181): a, c, t, g, unknown or other
  modified_base (199)..(199): a, c, t, g, unknown or other
  modified_base (205)..(205): a, c, t, g, unknown or other
  modified_base (228)..(228): a, c, t, g, unknown or other
  modified_base (234)..(234): a, c, t, g, unknown or other
  modified_base (310)..(310): a, c, t, g, unknown or other
tcagcgatcgtatacacgaccggtgctcgatttagtcgagctctctcgcgggcacgaccggtgctcgatttagtcgagctctcagagagaaagggggancatcacccagcaaccacatctgtcctctagagaatcccctgagagctccgttcctcaccatggactggacctggagatcctnttctggtgcagcaaccanaggacncccactcccaggtgcagctggtncagtcnggggactgaggtgaagagccgtgggcctacgagtaggaaggtctacctgacaaagtcttcgtggactacacccttnaccgactaactatatcgcatgggtgccgacgagcccctggacaagggcttggagtggatgggatgactcgacctaagatgtcgacaacaaatactagacacagtacgttttacagggtctacggggtacacctactacgaccgaacgtacggacaacacttaacgacgacgaacactacgtactacgtacgtacgtacgtacgtacgtaacgtaccgtacgaccgaccgaccggtacggttacgtttacg

SEQ ID NO: 375532 - DNA, 813 bp, Homo sapiens
  misc_feature: GZ8MTXP02J2S7R.51.82.H05.1.454.CMB.2.raw
  modified_base (255)..(255): a, c, t, g, unknown or other
tcagcgatcgtatacacgaccggtgctcgatttagtcgagctctctcgcgggggcttcagctgtggcacaagaggcagcactcaggacaatctccagcatggcctggtctcctctcctcctcactctcctcgctcactgcacagggtcctgggcccagtctgtactgacgcagccgcctcagtcgtcgtcggggccccagggcaggacgggtccacctagtcctccgtgctacgtgggaaacctagttcccaacnggttccggggactaaggttaactaagttcggtaacacgttacggtacccagtaccgtaacgttccgaacggaaccaaccgacccccctaaaactccctaacgactaccctattaacgggaaacttaaccaaacggtaaaaccgttccccggtacccggggtccgggggttacccccctacgggtaaccccgttatttcccgtcggtaccggtcctaccccgtaaagttcccttacgacctaccgtttaccacggtcccccttccgtacggtaccctagttaccctacggttccgggacccgttacccaagggtttacgtaaccggggagttacgtaacggggaaccgggtacttacggtaaacttaacgttaccgggttaacccccgtaccgttacccgttacgtaacgtaccggaacgtaccggtacgtaacggtccgtacggtaccgttcgggtttaccggtttcggggtttacccggggttaccgggaccgggtaacccggtaaccgtaccggtaccggttaccggtacccgttaccggtacggacccgtaccgg

SEQ ID NO: 375533 - DNA, 528 bp, Homo sapiens
  misc_feature: GZ8MTXP02G4XWN.51.82.H05.1.454.CMB.2.raw
  modified_base (322)..(322): a, c, t, g, unknown or other
  modified_base (339)..(339): a, c, t, g, unknown or other
  modified_base (386)..(386): a, c, t, g, unknown or other
  modified_base (426)..(426): a, c, t, g, unknown or other
  modified_base (433)..(433): a, c, t, g, unknown or other
tcagcgatcgtatacacgaccggtgctcgatttagtcgagctctctcgcgggggctctgcttcagctgtgggcacaagaggcagcactcaggacaatctccagcatggcctggtctcctctcctcctcactctcctcgctcactgcacagggtcctgggcccagtctgtactgacgcacggccgccctcgagtcgtcgtcggggccccagggcaggaggtcaccgatctcctgctacgtcgggaacagttccaacaggtcgggctaggttatatcgtacacgtgtaccagtcaaccttcaacggaacacacccccaaatccncactcatgacacagacncccggcctccggggtcctgcgtacttcgtcgagccgtacagtccgtnactctcgactcccgtccagccagtccacgtcgctacacgntagacgntaggcgatgtactatacgtcactatcactagcacgcgacggctgcgtcgtcgttcggttcggtcggcgtaccggtacacgtccgacgtacgtacg

SEQ ID NO: 375534 - DNA, 613 bp, Homo sapiens
  misc_feature: GZ8MTXP02F9H5H.51.82.H05.1.454.CMB.2.raw
  modified_base (269)..(269): a, c, t, g, unknown or other
  modified_base (285)..(285): a, c, t, g, unknown or other
  modified_base (298)..(298): a, c, t, g, unknown or other
  modified_base (528)..(528): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcgttgggtggcagaccaaccacgaggacgcccacctcccgaggtgcagcgtggtgcagtcgtgggactgaggtagaagacgccgngggctgagtgacgtcncgtgacagtctgnggactacgtacctcgaccgtactactatgtcgctaggtggtcgacccgacgaccggcccgtaggaacgtacgggtcgtaggacggtgggtacggtaggtacgtaaggtacgtaaccggtaaaccgtaagtaggtacggtacgaaccctaaacgtaaactcgtacgacgtaacgtagttacgtttacggacggttcgtacggtacacgtaggtacacgtagcaatcaagtnaacgacctaacgacgagttaccagtacggtacgtacgtacgtacgcgtaccgtaacgaccggacgtccggtacgtttaggtttac

SEQ ID NO: 375535 - DNA, 580 bp, Homo sapiens
  misc_feature: GZ8MTXP02FT06I.51.82.H05.1.454.CMB.2.raw
  modified_base (203)..(203): a, c, t, g, unknown or other
  modified_base (414)..(414): a, c, t, g, unknown or other
  modified_base (422)..(422): a, c, t, g, unknown or other
  modified_base (441)..(441): a, c, t, g, unknown or other
tcagcgatcgtatacacgaccggtgctcgatttagtcgagctctctcgcgggcacgaccggtgctcgatttagtcgagctctcagagagaaagggggagcatcacccagcaaccacatctgtcctctagagaatcccctgagagctccgttcctcaccatggactggacctggaggatcctcttcttgggtggcagcaaccanaggagcccactcccaggtgcagctggtgcagtctggggactggaggtgaagagctggggcctcgagtgaacggtctcctgacaagtctttcgtggactacaccttcaccgtactactatatcgcactggggtgcccgacacggcccctaggacaaggggcttggatgggagtgggatggactcggaccctaagaagtgtgaccacaaactntgacaganctttacgaggtgtcgggtnacccagtagacccgagacgaacacacttacctagaccaaaacacggaacgtacctaagtacgttacggtaaagttccggaaaccaacggggtacctacgtaaccggaccccgtaaagggtcccgttaaggtttttacgg

SEQ ID NO: 375536 - DNA, 563 bp, Homo sapiens
  misc_feature: GZ8MTXP02FE3AG.51.82.H05.1.454.CMB.2.raw
  modified_base (249)..(249): a, c, t, g, unknown or other
  modified_base (300)..(300): a, c, t, g, unknown or other
  modified_base (331)..(331): a, c, t, g, unknown or other
  modified_base (357)..(357): a, c, t, g, unknown or other
  modified_base (366)..(366): a, c, t, g, unknown or other
  modified_base (391)..(391): a, c, t, g, unknown or other
  modified_base (397)..(397): a, c, t, g, unknown or other
  modified_base (490)..(490): a, c, t, g, unknown or other
tcagcgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagcccgcctcagtgtcgtcggggccccagggcaggacgggtcaccatcctcctgcacgtaggaactagttacccaanagtcggggcaggttaataatgtacacgtggtaccagccaacttcaggaacncgacccccaaatcctcactccatgacacganaacgccgcccgttcggggtacccccngacctatcncgtggctcaagtctgactcttcacncctccncgctatcagtcggctccgagacgtgacggatcggagcgtagtacttatttacgcgacctacgtctaagtcaacgagtcgaggactaagtcctntaccggttgtttcggggtttcgggaccggtacggaaccgacgtcgtacgtccgtaccgttaacgcgaacccgg

SEQ ID NO: 375537 - DNA, 523 bp, Homo sapiens
  misc_feature: GZ8MTXP01BR96P.17.43.D10.1.454.CMB.2.raw
  modified_base (183)..(183): a, c, t, g, unknown or other
  modified_base (273)..(273): a, c, t, g, unknown or other
  modified_base (298)..(298): a, c, t, g, unknown or other
  modified_base (344)..(344): a, c, t, g, unknown or other
  modified_base (381)..(381): a, c, t, g, unknown or other
  modified_base (507)..(507): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgttcnccaggggacagccacctctcctgcagggccagtcagagtgtgagcagcaacttgcctggtatcagcagaacctggccaggctccagctcncatctatgtgcttccacgagggccnctggtcgtcccagccagattcgaggggcagtgggtctgggaacagngttcactctcacatcagcagcctgcagtctagaagtntttgctagtttatactgtcagtcactaataataacgtcgggaccccggggggtacgtcggaccgaagggaccgaagggtggaagagtacgaaacggtaaacgtgttacgggcttgcaccgaattcngttcttcgaagttccc

SEQ ID NO: 375538 - DNA, 521 bp, Homo sapiens
  misc_feature: GZ8MTXP01A22C3.17.43.D10.1.454.CMB.2.raw
  modified_base (357)..(357): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgcttccaccagggcccgctgggtcgtcccagccagattcgaggggcaggtgggtctgggaacagngttcactctcaccatcagcagcctgcagtctagagtatttgctagtttattactgtcagtcactataataacgtcgggccccggggggtagttccggccgaagggaccgaagggtggagatacaaacgaactgttagcttgcaccaatctgttcttcaattccc

SEQ ID NO: 375539 - DNA, 492 bp, Homo sapiens
  misc_feature: GZ8MTXP01BG4P1.17.43.D10.1.454.CMB.2.raw
  modified_base (184)..(184): a, c, t, g, unknown or other
  modified_base (278)..(278): a, c, t, g, unknown or other
  modified_base (288)..(288): a, c, t, g, unknown or other
  modified_base (348)..(348): a, c, t, g, unknown or other
  modified_base (355)..(355): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagccaccctctcctgcagggccagtcagagtgtgagcagcaacttagcctggtatcagcagaactggccaggctccagctcctnatgtatggtncatctaccagggccactggtcgtcccagccaggttcagtggcaggtgggtctaggggacngagttcnctctcatcatcagcagcctgcagtctgaagtatttgcgtttatacgtggtcagcagtataatcagtggcctccggtggacgttcggcaagggaccaaggttgaaatcaaacgacttgtggctggcacatcttgttcc

SEQ ID NO: 375540 - DNA, 520 bp, Homo sapiens
  misc_feature: GZ8MTXP01A6M98.17.43.D10.1.454.CMB.2.raw
  modified_base (307)..(307): a, c, t, g, unknown or other
  modified_base (355)..(355): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaacctggccaggctcccaggctcctcatctatggtgcttccaccagggccnctggtcgtcccagccagattcgaggggcaggtgggtctggggaacagngttcactctcaccatcagcagcctgcagtctagaagtatttgctagtttatactgtcagtcactataataacgtcggccccggggggagttccggaccgaagggaccaagggtggaagagtacgaaacgactagttggcttgcaccaatctgttcttcaattccc

SEQ ID NO: 375541 - DNA, 544 bp, Homo sapiens
  misc_feature: GZ8MTXP01BW1C1.17.43.D10.1.454.CMB.2.raw
  modified_base (288)..(288): a, c, t, g, unknown or other
  modified_base (304)..(304): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccaggggaacagccacctctcctgcagggccagtcagagtgtgagcagcaacttgcctggtatcagcagaacctggccaggctccaggctcctcatctatggtncttccaccgagggccncgtgggtcgtcccagccagattcgaggggcaggtgggtctggggaacagcgttcacgtctcacatcagcagcctgcagtctagaagtatttgctagtttatactgtcagctaactaagtaactacgtcggggacccccggggggtagttccgggaccgaaggggaccgaagggtgggaagagtacgaaacgaacgtggttacgggcttggcaccgaattcgtgttccttcaacgttcccg

SEQ ID NO: 375542 - DNA, 597 bp, Homo sapiens
  misc_feature: GZ8MTXP01DI2AE.17.43.D10.1.454.CMB.2.raw
  modified_base (184)..(184): a, c, t, g, unknown or other
  modified_base (194)..(194): a, c, t, g, unknown or other
  modified_base (202)..(202): a, c, t, g, unknown or other
  modified_base (296)..(296): a, c, t, g, unknown or other
  modified_base (307)..(307): a, c, t, g, unknown or other
  modified_base (315)..(315): a, c, t, g, unknown or other
  modified_base (391)..(391): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncaggggaacngccacctntcctgcagggccagtcagagtgtgagcagcaaacttgcctggtatcagcaagaaacctggccaggcctcccgaggcctcctcatctagtggtcnccttccaccgnggggcccntgggtctcccagccagtacttcgaggggcagggtgggtctggggaacaggtgttcacgtctcaccatcagcagccngcagtctagaagtatttgacttagtttaattacgtgtacagtctaaacttaagtaaacgtaaccgtcgggggtaccccggggggtacttaccggggacccgaaacgggggtaaccaaaggggtcggaaagaacgtacgaaaacggtacgttggttacgggcttacggaaccacgtaacgttctacgttcttcgttaacgttccccg

SEQ ID NO: 375543 - DNA, 527 bp, Homo sapiens
  misc_feature: GZ8MTXP01BT2HP.17.43.D10.1.454.CMB.2.raw
  modified_base (197)..(197): a, c, t, g, unknown or other
  modified_base (250)..(250): a, c, t, g, unknown or other
  modified_base (358)..(358): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacngccaccctctcctgcagggccagtcagagtgtgagcagcaacttgcctggtancagcagaacctggccaggctccaggctcctcatctatggtgcttccaccgagggccgctgggtcgtcccagccagattcgacgggggcaggtgggtctggggaacagngttcactctcaccatcagcagcctgcagtctagaagtatttgctagtttattactgtcagtcatataatacgtcgggcccgggggtactcggcgaagggccgaagggtggagacgtacgaaacgaacgtgttcggcttcggcaccaagttctgttcttcgaagttcccg

SEQ ID NO: 375544 - DNA, 577 bp, Homo sapiens
  misc_feature: GZ8MTXP01EUTO6.17.43.D10.1.454.CMB.2.raw
  modified_base (295)..(295): a, c, t, g, unknown or other
  modified_base (311)..(311): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggcctcccaggctcctcatctatggtcncttccaccgagggccnctgggtcgtcccagccagacttcgagggggcaggtgggtctggggaacaggtcgttcactctcaccatcagcagcctgcagtctagaagttatttgcttagtttattactgtcagtactaactaataaacgtaaccggtcggggtaccccggggggtacgttccgggaccgtaaacggggaccgaaaggggtcggaagagtacgaaacggtacgttggacggcttacggctaccgtaattcgttgttccttcgttaactttccccg

SEQ ID NO: 375545 - DNA, 579 bp, Homo sapiens
  misc_feature: GZ8MTXP01CKLDM.17.43.D10.1.454.CMB.2.raw
  modified_base (184)..(184): a, c, t, g, unknown or other
  modified_base (228)..(228): a, c, t, g, unknown or other
  modified_base (296)..(296): a, c, t, g, unknown or other
  modified_base (310)..(310): a, c, t, g, unknown or other
  modified_base (316)..(316): a, c, t, g, unknown or other
  modified_base (325)..(325): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacagccaccctctcctgcagggccagtcagagtgngagcagcaacttgcctggtatcagcaagaaacctggccaggcctcccaggcctcctcatctatggtcncttccacgaggccntggtcnccagccagnttcgaggggcaggtgggtctgggaacagtgtcactctcaccatcagcagcctgcagtctagtaagttatttgacttagtttattactgtacagtactaacttaagtaaacgtaaccggtccgggggaccccggggggtacgttcgggaccgaacggggaaccgaaggggtaacggaagactaacgaaaacggtaacgtgggttacggccgttagcccgtaaacctgttctcggttcttccttaacgtttccccg

SEQ ID NO: 375546 - DNA, 521 bp, Homo sapiens
  misc_feature: GZ8MTXP01DWL0N.17.43.D10.1.454.CMB.2.raw
  modified_base (282)..(282): a, c, t, g, unknown or other
  modified_base (291)..(291): a, c, t, g, unknown or other
  modified_base (300)..(300): a, c, t, g, unknown or other
  modified_base (306)..(306): a, c, t, g, unknown or other
  modified_base (391)..(391): a, c, t, g, unknown or other
  modified_base (502)..(502): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaacctggccaggctccaggctcctnatcatggtncttccacgngggccnctggtcgtcccagccagattcgaggggcaggtggtctggggaacagtgttcactctcaccatcagcagcctgcagtctagaagtntttgctagtttatactgtcagtcaatataagtaacgtcggggaccccggggggtagttccggaccaaggggaccaagggtggagatacgaaacgaacgtgaggcttgcacntctgttcttcgaacttccc

SEQ ID NO: 375547 - DNA, 533 bp, Homo sapiens
  misc_feature: GZ8MTXP01CIOC8.17.43.D10.1.454.CMB.2.raw
  modified_base (184)..(184): a, c, t, g, unknown or other
  modified_base (309)..(309): a, c, t, g, unknown or other
  modified_base (348)..(348): a, c, t, g, unknown or other
  modified_base (350)..(350): a, c, t, g, unknown or other
  modified_base (366)..(366): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncaggggaacagccacctctcctgcagggccagtcagagtgtgagcagcaacttgcctggtatcagcagaactggccaggctccaggctcctcatctatggtgcttccaccgagggccgctgggtntcccagccagattcgacggggcaggtgggtctgggaacngngtcactctcacatcancagcctgcagtctagtaagtatttgctagtttattactgtcagtcatataataacgtcgggaccccggggggtacgttccgggaccgagggacccgaagggtaaggacgagtacgaaacgtaacgtggttaggcttggcctacgaatctagttcttcgcgtttcccg

SEQ ID NO: 375548 - DNA, 567 bp, Homo sapiens
  misc_feature: GZ8MTXP01B2B5W.17.43.D10.1.454.CMB.2.raw
  modified_base (185)..(185): a, c, t, g, unknown or other
  modified_base (309)..(309): a, c, t, g, unknown or other
  modified_base (406)..(406): a, c, t, g, unknown or other
  modified_base (545)..(545): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagccacctctcctgcagggccagtcagagtgtgagcagcaacttagcctggtatcagcaagaacctggccaggctccgaggctcctcatctatggtcgcttccgacgagggccncgtgggtcgtccccagccagtcttcgacggggcaggtggggtctggggaacaggtcgttcaacgtctcacctatcagcagcctgctagtctagagtntttcgacttagtttacttactgtcacgtctactaataacgtaaccggtcggggaccccgggggtatccgggtacgaacgggaccgtaagggcggtaacgagtacgaaacgtaacgtcgttaggttcttcgaactacctnttcgtcgttcttcgttcgtccg

SEQ ID NO: 375549 - DNA, 536 bp, Homo sapiens
  misc_feature: GZ8MTXP01EAWBB.17.43.D10.1.454.CMB.2.raw
  modified_base (195)..(195): a, c, t, g, unknown or other
  modified_base (276)..(276): a, c, t, g, unknown or other
  modified_base (287)..(287): a, c, t, g, unknown or other
  modified_base (304)..(304): a, c, t, g, unknown or other
  modified_base (320)..(320): a, c, t, g, unknown or other
  modified_base (350)..(350): a, c, t, g, unknown or other
  modified_base (520)..(520): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggaacngccacctctcctgcagggccagtcagagtgtgagcagcaacttgcctggtatcagcagaacctggccaggctccaggctcncatctatggtncttccaccgagggccgntggtctcccagccagnttcgaggggcaggtgggtctggggaacagngttcactctcaccatcagcagcctgcagtctagaatatttgactagtttattacgtgtacagtctaactaataagtaaccggtcggggtaccccggggggtattccgggaccgaaggggaccgaagggtcggaagagtacgaaacgtaatggttacggcttcgcaccttntctcttcttcttctcc

SEQ ID NO: 375550 - DNA, 556 bp, Homo sapiens
  misc_feature: GZ8MTXP01EM2AI.17.43.D10.1.454.CMB.2.raw
  modified_base (281)..(281): a, c, t, g, unknown or other
  modified_base (291)..(291): a, c, t, g, unknown or other
  modified_base (534)..(534): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagcaacttagcctggtatcagcagaaacctggccaggctccagctcnatctatggtnccttccaccgaggggccgcgtcgggtcgtccccagccagacttcgaggggcaggtgggtctggggaacagtgttcactctcacatcagcagcctgcagtctagtaagttatttgcttagtttattactgtacagtctaacttaataacgtaaccggtccgggggaccccggggggtacttccgggaccggaaaggggaccgaagggtcggaagatacgaaacgtacgtggttgcttgctactnttcgtattcttcgaagttcccg

SEQ ID NO: 375551 - DNA, 579 bp, Homo sapiens
  misc_feature: GZ8MTXP01C94KA.17.43.D10.1.454.CMB.2.raw
  modified_base (184)..(184): a, c, t, g, unknown or other
  modified_base (196)..(196): a, c, t, g, unknown or other
  modified_base (206)..(206): a, c, t, g, unknown or other
  modified_base (252)..(252): a, c, t, g, unknown or other
  modified_base (281)..(281): a, c, t, g, unknown or other
  modified_base (290)..(290): a, c, t, g, unknown or other
  modified_base (305)..(305): a, c, t, g, unknown or other
  modified_base (311)..(311): a, c, t, g, unknown or other
  modified_base (322)..(322): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (387)..(387): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacngcccacctcncctgcagggccagtcaggagtgtgagcagctaaacttgcctggtancagcaagaacctggcaggctccagctctnatcatggtncttccacgagggccntggtcncccagccagtntcgaggggcaggtggcngggaacagngttcactcncaccatcagcagcctgcagtcagtaagttntttgacttagtttatactgtacgacgtactaactaagtaacgtaaccggtccgggggtaccccgggggtacgtacgggaaccgaaacggggaccgaaagggtcggaaacgttaacgtaaacgaaaacgtaacgtggttacggcttacggaacctaacgtaacgttcgttcgttacctttcgttaacgttccg

SEQ ID NO: 375552 - DNA, 644 bp, Homo sapiens
  misc_feature: GZ8MTXP01CN8P5.17.43.D10.1.454.CMB.2.raw
  modified_base (183)..(183): a, c, t, g, unknown or other
  modified_base (202)..(202): a, c, t, g, unknown or other
  modified_base (290)..(290): a, c, t, g, unknown or other
  modified_base (304)..(304): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctccagatactactggagaaatggtgatgacgcagtctccagccaccctgtctgtttcnccaggggaacagccacctntcctgcagggccagtcagagtgtgagcagcaacttagcctggtatcagcagaaacctggccaggctcccaggctctcatctatggtcnctccacgacggccncgtggtcgccagccagtactcggacggggcaggtcgggtcgtacgggaacagtcgttcactctacaccatcagcacgcctacgcgacgtacgtagtaagttagtttacgtacgttacgtttaactttacgttacgttacggtacgtacgtaactaaacgttaaacgttaaaccggtacccgggggtaccccgggggtacccggggttaccgggtaaccggtaaaccgggtaaccggtaaacgggtaacgggtaacggaacgtaaacgaaacggtaaacgtacggttacggttcgttacgtaaccgaccgtaacgtcgttacgttcttcgttaacgttccg

SEQ ID NO: 375553 - DNA, 531 bp, Homo sapiens
  misc_feature: GZ8MTXP01B8SMX.17.43.D10.1.454.CMB.2.raw
  modified_base (184)..(184): a, c, t, g, unknown or other
  modified_base (274)..(274): a, c, t, g, unknown or other
  modified_base (280)..(280): a, c, t, g, unknown or other
  modified_base (283)..(283): a, c, t, g, unknown or other
  modified_base (297)..(297): a, c, t, g, unknown or other
  modified_base (339)..(339): a, c, t, g, unknown or other
  modified_base (341)..(341): a, c, t, g, unknown or other
  modified_base (355)..(355): a, c, t, g, unknown or other
  modified_base (514)..(514): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccaggggaacagccacctctcctgcagggccagtcagagtgtgagcagcaacttgcctggtatcagcagaacctgccaggctccagctcnatctangtncttccaccaggccnctggtctccagccagattcgaggggcaggtggtctgggaacngngttcattcacaccntcagcagcctgcagtctagaagtatttgactagtttattactgtcagtctaactataaagttacccgtcggggccccgggggtattccggccgtaaaggggaccaaggggtaagaaggttatacgaaacgaacgtggttacggcttagcaccaagttcngttcttcgaattccccg

SEQ ID NO: 375554 - DNA, 536 bp, Homo sapiens
  misc_feature: GZ8MTXP01CKC2R.17.43.D10.1.454.CMB.2.raw
  modified_base (308)..(308): a, c, t, g, unknown or other
  modified_base (512)..(512): a, c, t, g, unknown or other
tcagcgtagactagcacgaccggtgctcgatttagactagcagtaagggggaactgctcagttaggacccagacggaaccatggaagccccagcgcagcttctcttcctcctgctactctggctcccagatactactggagaaatggtgatgacgcagtctccagccaccctgtctgtttctccaggggaacagcccaccctctcctgcagggccagtcagagtgtgagcagcaacttagcctggtatcagcagaacctggccaggctcccaggctcctcatctatggtgccttccaccgaggggccnctggtcgtccccagccagattcgaggggccaggtgggtctggggacaggagttcactctcaccatcagcagcctgcagtctgaagtattttgctagtttattactgtcaggctaactataactaacgtcgggccccgggggtagttccggccgtaaggggaccgaagggtggaagacgttcgaaacgacgtgtggcttgcaacntctgtcttctaacttccgttcccg

SEQ ID NO: 375555 - DNA, 602 bp, Homo sapiens
  misc_feature: GZ8MTXP01BW75P.17.43.D10.1.454.CMB.2.raw
  modified_base (197)..(197): a, c, t, g, unknown or other
  modified_base (294)..(294): a, c, t, g, unknown or other
  modified_base (365)..(365): a, c, t, g, unknown or other
  modified_base (402)..(402): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacngccaccctctcctgcagggccagtcagagtgtgagcagcaacttagcctggtatcagcagaacctggccaggctcccaggctcctcatctatggtcnccttcccaccgaggggcccgcgtgggtcgtcccagccagattcgaggggcaggtgggtctggggaacaggngttcactctcacatcagcagcctgcagtctagaagtntttgacttagtttattacgtgtacagtctaacttaagttaaacgtaaccggtccgggggacccccggggggttacgttccgggacccggtaaacggggtaacccgaaaggggtcggaagaacgttaacgaaaacggtaacgtgggttacggcttacggaacctaccgtaattcgtcgttccttaaccgttaacttccccg

SEQ ID NO: 375556 - DNA, 562 bp, Homo sapiens
  misc_feature: GZ8MTXP01B0KJ2.17.43.D10.1.454.CMB.2.raw
  modified_base (185)..(185): a, c, t, g, unknown or other
  modified_base (295)..(295): a, c, t, g, unknown or other
  modified_base (311)..(311): a, c, t, g, unknown or other
  modified_base (365)..(365): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagcccaccctctcctgcagggccagtcagagtgtgagcagcaacttgcctggtatcagcaagaacctggccaggcctcccaggctcctcatctatggtcncttccaccgagggccncgtcgggtcgtcccagccaggacttcgacgggggcaggtgggtctgggaacagngttcactctcacatcagcagcctgcagtctagaagtatttgctagtttatactgtcagtctaactaataacgtaacgtccgggggaccccggggggtatccggggaccgaaggggaccgtaagggtaagaagttacgaacgaaaaggacgtggcgcgttcggaaccacgtaatctgttacttcgttaacgtttcccg

SEQ ID NO: 375557 - DNA, 576 bp, Homo sapiens
  misc_feature: GZ8MTXP01CKMIX.17.43.D10.1.454.CMB.2.raw
  modified_base (185)..(185): a, c, t, g, unknown or other
  modified_base (197)..(197): a, c, t, g, unknown or other
  modified_base (298)..(298): a, c, t, g, unknown or other
  modified_base (310)..(310): a, c, t, g, unknown or other
  modified_base (316)..(316): a, c, t, g, unknown or other
  modified_base (336)..(336): a, c, t, g, unknown or other
  modified_base (363)..(363): a, c, t, g, unknown or other
  modified_base (404)..(404): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacngccaccctctcctgcagggccagtcagagtgtgagcagcaacttagcctggtatcagcagaacctggccaggcctcccgaggcctcctcattctatggtcnccttccgaccgngggccncgtgggtcgtcccagccagnttcgaggggcaggtggtctggggaacngcgttcacgtctcaccatcagcagcctgcagtctagtagtntttgcttagtttatactgtacagtactagttaataacgtaccggtccggggaccccgggggtacgttccggaccgtaaggggacccaaggggtgaacgacgtaacgaaacggtacgtggttacggcttcggaacccacgtaactccgttacgttctttccgaactttccccg

SEQ ID NO: 375558 - DNA, 632 bp, Homo sapiens
  misc_feature: GZ8MTXP01BTWO3.17.43.D10.1.454.CMB.2.raw
  modified_base (185)..(185): a, c, t, g, unknown or other
  modified_base (197)..(197): a, c, t, g, unknown or other
  modified_base (282)..(282): a, c, t, g, unknown or other
  modified_base (292)..(292): a, c, t, g, unknown or other
  modified_base (361)..(361): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacngcccaccctctcctgcagggccagtcagagtgtgagcagctaacttgcctggtatcagcagaacctggccaggctccaggctctnatctatggtncttccaccgagggccgctgggtcgtcccagccagattcgacgggggcaggtgggtcgtggggaacaggngtttcactctcaccgatcagcagcctgcagtcgtagaagtatttgactagtttattactgtacagtactaactaataacgtaaccggtccgggggtacccccgggggggtaacgttccggggaacccgtaagggggaacccgaagggggttaacgggaacggttaacgttaaccgaaaacgggtaaaccgttggggttacgggttccgttacggaaccgtaacccgtaacttccgggttacgttcctttaaccgttaaccgttttcccccg

SEQ ID NO: 375559 - DNA, 542 bp, Homo sapiens
  misc_feature: GZ8MTXP01BQBWY.17.43.D10.1.454.CMB.2.raw
  modified_base (306)..(306): a, c, t, g, unknown or other
  modified_base (354)..(354): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccacctctcctgcagggccagtcagagtgtgagcagcaacttgcctggtatcagcagaacctggccaggctcccaggctcctcatctatggtgcttccaccgagggccnctggtcgtcccagccagattcgaggggcaggtgggtctgggaacaggngttcactctcaccatcagcagcctgcagtctagatatttgctagtttatactgttcagctactataataacgtcggggcccccggggggtaagttccgggccgaaggggacccgaagggtaagggaagagtacgaaacgtaacgtgttaggcttcggcacgtaacgtctgttacctcttaacttcccg

SEQ ID NO: 375560 - DNA, 643 bp, Homo sapiens
  misc_feature: GZ8MTXP01EYRSF.17.43.D10.1.454.CMB.2.raw
  modified_base (184)..(184): a, c, t, g, unknown or other
  modified_base (289)..(289): a, c, t, g, unknown or other
  modified_base (301)..(301): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacagcccaccctctcctgcagggccagtcagagtgtgagcagctaacttagcctggtatcagcaagaaacctggccaggcctcccgaggcctcctnatctagtggtcnccttccgaccgaggggcccgtcgtgggtcctccccgagcccaaggtacgtttcggacgggggtcctaggggtggggtaccgtagggggaaacctagggtaacgtttccaacttcctaccaaccctatccgagcacgcctgactagtctagtaagttatttgacttagtttaacttacgtgtacacgtactaactaagtaaacgtaccggtcccgggggaccccggggggtagttaccgggaccggaaacggggaccgaaggggtaagaacgttaaagtacgaaacgtacgtggttacgggcttacggaacctacgtaagttctcgttccttcgttcgttccg

SEQ ID NO: 375561 - DNA, 600 bp, Homo sapiens
  misc_feature: GZ8MTXP01DI4FR.17.43.D10.1.454.CMB.2.raw
  modified_base (185)..(185): a, c, t, g, unknown or other
  modified_base (251)..(251): a, c, t, g, unknown or other
  modified_base (278)..(278): a, c, t, g, unknown or other
  modified_base (289)..(289): a, c, t, g, unknown or other
  modified_base (304)..(304): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagcccacctctcctgcagggccagtcagagtgtgagcagctaacttgcctggtancagcagaactggccagctccagcctcnatctatggtcncttccacgagggccngttggtctcccagccagcgttcgaggggctagggtgggtctggggaacagtcgttcacgtcctacacccatcgagctacgccgtcgcgtagttctaggtaacgttagtttgacgttagtttattacgtcgtactacgtactaacttaacgttaaacgtaccgggtccgggggaccccggggggtacgttccgggaccggaaacgggccgaagggtaacggaagacgtaacgaaacgtaacgtggcggttcgttcgtcctaacgtcgttacgtcgttccttcttaaccgtttccccg

SEQ ID NO: 375562 - DNA, 590 bp, Homo sapiens
  misc_feature: GZ8MTXP01DRFXF.17.43.D10.1.454.CMB.2.raw
  modified_base (195)..(195): a, c, t, g, unknown or other
  modified_base (276)..(276): a, c, t, g, unknown or other
  modified_base (285)..(285): a, c, t, g, unknown or other
  modified_base (296)..(296): a, c, t, g, unknown or other
  modified_base (301)..(301): a, c, t, g, unknown or other
  modified_base (330)..(330): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggaacngccacctctctgcagggccagtcagagtgtgagcagacaacttagcctggtaatcagcagaaacctgcaggctccagctcnatctatgtnctcacaggccntggtntccagccagattcgaggggcaggtggtcngggaacagtgttcactcgtacaccatcagcagctgcagtctagagtatttgcttagttattactgtacagtctaactaagtaacgttaaccggccgggggtacccccggggggtaaacgttccgggaaccgtaacgggggacccgtaaagggggttaaggaaagttacgttacggaaaaacgtaacgttgggttaacggggccttacggaacctaaacccgttaacgttccgtcgttaccttaaccgttaaccgttcccg

SEQ ID NO: 375563 - DNA, 555 bp, Homo sapiens
  misc_feature: GZ8MTXP01BB2Q8.17.43.D10.1.454.CMB.2.raw
  modified_base (196)..(196): a, c, t, g, unknown or other
  modified_base (250)..(250): a, c, t, g, unknown or other
  modified_base (270)..(270): a, c, t, g, unknown or other
  modified_base (275)..(275): a, c, t, g, unknown or other
  modified_base (286)..(286): a, c, t, g, unknown or other
  modified_base (294)..(294): a, c, t, g, unknown or other
  modified_base (301)..(301): a, c, t, g, unknown or other
  modified_base (346)..(346): a, c, t, g, unknown or other
  modified_base (363)..(363): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacngcccaccctctcctgcagggccagtcagagtgtgagcagcaacttgcctggtancagcagaactgccagctccngctcnatctatggtcnctccacgngggccgntggtctcccagccagtcttcggaggggcaggtggtcgtgggaacngtgttcactcctcaccntcagcagcctgcagtctagtattatttgcttagtttatacgttgtcagtctactaataacgtaacggtccggggaccccgggggtacgttcgggaccgtaaagggccgaagggtcggaagacgtaacgaaacggtacgtggttacggttcgttcggaactacgtaacgttctcgttcttcgttaacttcccg

SEQ ID NO: 375564 - DNA, 613 bp, Homo sapiens
  misc_feature: GZ8MTXP01DVQKS.17.43.D10.1.454.CMB.2.raw
  modified_base (184)..(184): a, c, t, g, unknown or other
  modified_base (196)..(196): a, c, t, g, unknown or other
  modified_base (249)..(249): a, c, t, g, unknown or other
  modified_base (284)..(284): a, c, t, g, unknown or other
  modified_base (295)..(295): a, c, t, g, unknown or other
  modified_base (322)..(322): a, c, t, g, unknown or other
  modified_base (380)..(380): a, c, t, g, unknown or other
  modified_base (586)..(586): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacngccacctctcctgcagggccagtcagagtgtgagcagcaacttagcctggtancagcaagaaacctggaccaggcctccaggcctccnatctatggtcnccttcccgacgagggcctgtcgggtcncccagccagtactcggaggggcagggtgggctggggaacagtcgttcacgttcacacntcagcagcctagctagtctaggtaattgttttcgacttagtttattacgtgtacacgtactaacgttaagtaaacggtacccgggtcccggggggaacccccgggggtaagttacccggggaaccggaaacgggggtacccgtaaagggggtgtaacgaacgttaaacggaaaacggtacgtggttacgggttcacgtcctaaccngtttctcgttacttccttcgtttcccc

SEQ ID NO: 375565 - DNA, 564 bp, Homo sapiens
  misc_feature: GZ8MTXP01EO2YB.17.43.D10.1.454.CMB.2.raw
  modified_base (297)..(297): a, c, t, g, unknown or other
  modified_base (509)..(509): a, c, t, g, unknown or other
  modified_base (543)..(543): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagcaacttagcctggtatcagcagaacctggccaggctcccaggcctcctcatctagtggtcncttccaccgaggggccccgtcgtgggttcgtccccagcccagacttcggacgggggtcagggtgggtcgtggggaaccaggtggtttccaacgttcctaccaccgtatccagcagcctgctagtctagaagttatttgctagtttatactgtcagtactatataactacgtccggggccccgggggtatcggaccgagggaccgaggtgganagtacaaacgtacgtggacggcttcgctaaccgnttctgttacttcaagttcccc

SEQ ID NO: 375566 - DNA, 887 bp, Homo sapiens
  misc_feature: GZ8MTXP01CKWK2.17.43.D10.1.454.CMB.2.raw
  modified_base (183)..(183): a, c, t, g, unknown or other
  modified_base (194)..(194): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctccagatactactggagaaatggtgatgacgcagtctccagccacctgtctgtttcncgaggggaacngccacctctcctgcaggccagtcagagtgtgagcagactaacgttgccttaggtaatcgaaggacaaacgtaaacccgtggacccagggccctcccgaaggtcctcctactagttctagtcgggtctcccttacccgaccggtacgggggccccgtcgtttcggggtccgtccccgaaggcccgtaaaggtacgtttaccgggaacggggggtcctaagggggttcgggggtaccgtacgggggaaaacctaagggttaaccgttttacccaaaccgttccctaaccccgaaacccgtacgttaccgaaacgggtccctaacggtccccgtaggaccgtaacggttacccgttaaagggttaaaacgtttagtttttacggaaccgttttaaagggtttttaaccttaccgtttaggttaccaaacggttaacccttaaaaccgtttaaaggtttaaaaccggttaaaccccgggggttcccccggggggggtaaccccccggggggggtttaaaccgttccccgggggtaaacccgggtaaaacgggggaaccccggtaaaagggggttaacgggaaaccggttaaacgttaaacccggaaaaaccggttaacggttgggttaccgggttcttaccggaacctaacccgttgtttcccggtcgtttaccctttccgttaaccgtttcccccg

SEQ ID NO: 375567 - DNA, 545 bp, Homo sapiens
  misc_feature: GZ8MTXP01BSVC6.17.43.D10.1.454.CMB.2.raw
  modified_base (361)..(361): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtcgcttcccaccaggggcccgctgggtcgtcccagccagattcgagggggcaggtggggtctggggaacngtgttcactctcaccatcagcagcctgcagtctagagtattttgctagtttatactgtcagtctaactataaagtaaccgttcgggggcccccggggggtattccgggaccgaaggggtacccaaggggtcggagataccgaaagaacgtgaggcttggcaccaatctgttcctcaacttcccg

SEQ ID NO: 375568 - DNA, 665 bp, Homo sapiens
  misc_feature: GZ8MTXP01BJXPP.17.43.D10.1.454.CMB.2.raw
  modified_base (185)..(185): a, c, t, g, unknown or other
  modified_base (303)..(303): a, c, t, g, unknown or other
  modified_base (439)..(439): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagcccaccctctcctgcagggccagtcaggagtgtgagcagctaacttagcctggtatcagcaagaacctggccaggcctcccaggcctcctcatctagtcgggtcnccttcccgaccgacggggcccgtcgtgggtccgtcccagccagtacttcggacgggggctagggtcggggtccgtagggggaacaggtcgtttccaacttctaccacatcaagcacgcctgcgtagctagaagttnttttggactttagtttattacgttagtaccgtagtactaaacgttaacgttaaaccgtaacccgggtccgggggtacccccggggggttacgttacccggggtaaccggtaaacgggtaacccggaagggtaagggaacgttacgtaaaccgaaacggtaaacgtcggttcgggttcttacggccacctaacgttccttcgttccctttaacgttccgtttccccg

SEQ ID NO: 375569 - DNA, 656 bp, Homo sapiens
  misc_feature: GZ8MTXP01ATC30.17.43.D10.1.454.CMB.2.raw
  modified_base (294)..(294): a, c, t, g, unknown or other
  modified_base (396)..(396): a, c, t, g, unknown or other
tcagcgtagactagcacgaccggtgctcgatttagactagcagtaaggggggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttagcctggtatcagcagaacctggccaggcctcccaggcctcctcatctatggtnccttccaccgagggccctcgtgggtcgtccccaaggtcccagtacgttcggagggggtccctagggtggggtcgtaggggacaaggtacgtcactcacaccntcgagcacgcctcgacgtcgtcgtaggtaacgttatttcgactttaacgtttattacgttagtactaggacttaacgtaacgtaaacgttaccgggtcccggggggaccccgggggtacgttaccgggaccggtaacgggggtaccgtaaggggtggaacgtaacgttaaccggaaacggttacgtacgggtacggccgttcggaccctaaccgtagttccggttacttccgttacttaaccgttccccgtttaaccccg

SEQ ID NO: 375570 - DNA, 563 bp, Homo sapiens
  misc_feature: GZ8MTXP01DPHHE.17.43.D10.1.454.CMB.2.raw
  modified_base (185)..(185): a, c, t, g, unknown or other
  modified_base (395)..(395): a, c, t, g, unknown or other
  modified_base (555)..(555): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacgagccaccctctcctgcagggccagtcagagtgtgagcagcaacttagcctggtatcagcagaaacctggccaggcctcccgaggcctcctcatctagtggtcgccttcccaccgagggcccgtcgtgggtctcccgagccagattcgaggggcaggtgggtctggggaacagcgttcactctcacatcagcagctgcngtctgaatatttgactagtttatatgtactagtactactaagtaactaacggtcgggaccccgggggtacgtcgggaccgtaaagggaccgaaggtgggaagagtaacgaaacgtacgtggttcgggacttcggaacaccgtaatcgtacgttcttccgntttccccg

SEQ ID NO: 375571 - DNA, 626 bp, Homo sapiens
  misc_feature: GZ8MTXP01DMG5Y.17.43.D10.1.454.CMB.2.raw
  modified_base (184)..(184): a, c, t, g, unknown or other
  modified_base (249)..(249): a, c, t, g, unknown or other
  modified_base (262)..(262): a, c, t, g, unknown or other
  modified_base (270)..(270): a, c, t, g, unknown or other
  modified_base (280)..(280): a, c, t, g, unknown or other
  modified_base (293)..(293): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncgaggggaacagccacctctcctgcagggccagtcagagtgtgagcagcaacttagcctggtaancagacaacgaacngacagccnccgagcctcnatctagtcggtcncctaccgacggcggccgtgtggtcaccagccagtacgtcggacggggctagggtcggtcgtagggaaactagtcgtccactcctacaacatcacgctacgtccacgacgtagtacgtagtaagttagtttagtacgttaagtttaacttacttagtacgtaacgtaactaaacttaaacgttaaacgtaaccggtaccgggggtacccgggggtaccgggtaccggtaaccggaaacgggaacggaaggtaacggtaacgaacgtaaacgaaacgtaaacgtagttacggttcgttacgaacacgtaacgtcgttcgttacttcgttcgtccg

SEQ ID NO: 375572 - DNA, 562 bp, Homo sapiens
  misc_feature: GZ8MTXP01DMFBE.17.43.D10.1.454.CMB.2.raw
  modified_base (294)..(294): a, c, t, g, unknown or other
  modified_base (310)..(310): a, c, t, g, unknown or other
  modified_base (361)..(361): a, c, t, g, unknown or other
  modified_base (540)..(540): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagcccaccctctcctgcagggccagtcagagtgtgagcagcaacttgcctggtatcagcagaaacctggccaggctcccaggcctcctcatctatggtncttccaccaggggccncgtggtcgtcccagccagattcgacgggggcaggtgggtctggggaacagngttcacgtctcaccatcagcagcctgcagtctagaagtattttgacttagtttattactgtacagtacaacttaataaactaacgtcggggacccccggggggtacgttccgggaccgaaggggaccgaaggggtggaacgagtaccgaaaacgtaacgtggttcggcttggcaacctnttctgttcttcttaacttcccg

SEQ ID NO: 375573 - DNA, 600 bp, Homo sapiens
  misc_feature: GZ8MTXP01AMYB7.17.43.D10.1.454.CMB.2.raw
  modified_base (304)..(304): a, c, t, g, unknown or other
  modified_base (311)..(311): a, c, t, g, unknown or other
tcagcgtagactagcacgaccggtgctcgatttagactagcagtaaggggggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttgcctggtatcagcagaacctggccaggctcccaggctcctcatctagtggtcgccttccaccgngggcccncgtggtctcccgagccaagtacttcggagggggtccctagggttcggggtcgtaggggacctaaggtcgttcactcgtacaccatcagcacgctgctagtctagaagtattttgcttagtttatacgtgtacaggtctaacgttataaacgtaccggtccggggaccccgggggtacgttacggggaccgtaacgggaccgaagggtcggaagtacgacgaaacgacgtaggtggcgttcggactaaccgtacgtccttacggtcttactaacgttcccgttaaccccg

SEQ ID NO: 375574 - DNA, 670 bp, Homo sapiens
  misc_feature: GZ8MTXP01ECT7X.17.43.D10.1.454.CMB.2.raw
  modified_base (186)..(186): a, c, t, g, unknown or other
  modified_base (198)..(198): a, c, t, g, unknown or other
  modified_base (315)..(315): a, c, t, g, unknown or other
  modified_base (358)..(358): a, c, t, g, unknown or other
  modified_base (428)..(428): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggcctcccagatactactggaagaaatggtgatgacgcagtctccagccacctgtctgtttcnccgaggggaacngcccaccctctctgcgacgggccagtcaggtagtggtgacgcaagtactaacgttagccgttaggtactcgacgacgaaacgaaccgtcggaccacggccctcccgagtcctcctanattctagtcggtctcctacccgacggcgggcctcgtcggtccnccgagacctaggtacgtcggacggggctagggtcgggtacgaggggaactagtcgtcactccacaccgtntcgacgcacgtcgtagcgtagttacgtaagtaagtttgtttcgactttaagtttactacgtgtactaacgtacttaaacgtaagttaaccggtaacccggggtcccggggggtaaccccgggggttactccgggaaaccgggtaaacgggtaccggaaagggtaacgaacgttaactaaccgaaacgtcgtggttacggcttacgaacgtactcttcgtcgttactaaccttccgttccccg

SEQ ID NO: 375575 - DNA, 646 bp, Homo sapiens
  misc_feature: GZ8MTXP01B97CX.17.43.D10.1.454.CMB.2.raw
  modified_base (277)..(277): a, c, t, g, unknown or other
  modified_base (407)..(407): a, c, t, g, unknown or other
tcagcgtagactagcacgaccggtgctcgatttagactagcagtaaggggggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttgctggtatcagcagaacctggccaggctccaggctcnatctatggtgccttccgaccgacgggccgcgtggtcgtccccgagcccagtacgttcgagggggcctagggtggggtctggggacaagtacgttcactcgtacacatcagcagctgcagtctagaagttnttttagcttaagtttacttacgtgtactaacgtcgttaacttaagtaacgttaacggtcccgggggacccccggggggttacgttaccgggaccgtaaacggggacccgtaaaggggttgggaaacgtaacgttaaccgaaaacggttaaacgttcggggtacggaccgttcggaccctaacccgtaacgtttccgtcggtttcccgttaaccgttccctttccccggtttaacccccg

SEQ ID NO: 375576 - DNA, 698 bp, Homo sapiens
  misc_feature: GZ8MTXP01C2MEM.17.43.D10.1.454.CMB.2.raw
tcagcgtagactagcacgaccggtgctcgatttagactagcagtaaggggacataacaaccacattcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtctcggtgaaggtctcctgacaaggattcgtggaggcaacttcaaggtaacttactttagttaggttgggtacgtcaacggtcccctggacgaggggtcttggagtggagtggggaggatcagtccctgtcttcgtggtacggactaaacgttacgcaacgtacggtaacgttccgagggacaaggtaacgtaccgaacgtaacgttacccggacggtaacgtaactacgtaaacgaaacacgacgtacctaacgagtaggtaactacgtacgaactacgtaccgtagtaacgtacttacgtaacggggaaccgtaaccgtaaccgggttacgttttaacttcgtaggtggaaccgaggtaacgacctaaacgttcgtaacgtaaccttaaccgtttacttacgttttacgtaccgttaccgggttcggggacccgtaacggggtaaaccctcgggttacccgtacccgttacctccgttaacctaacccgg

SEQ ID NO: 375577 - DNA, 612 bp, Homo sapiens
  misc_feature: GZ8MTXP01DWZMV.17.43.D10.1.454.CMB.2.raw
  modified_base (287)..(287): a, c, t, g, unknown or other
  modified_base (298)..(298): a, c, t, g, unknown or other
  modified_base (418)..(418): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagacctaacttagcctggtatcagcagaaacctggccaggctcccaggctcctnatctatggtcncttcccaccgagggcccgcgtgggtcgtccccagcccgagattcgagggggccaggtggggtcctggggaaacaggtcgttcactcctcaccatcgagcagcctggcagtctagaagttntttgcttagtttatactgtcagtctaattaataagtaaccggtcggggtaccccggggggtacgttccgggtacgaacggggaaccgaaggggtaaggtaacgaacgttaacgaaaacggtaaaccgtggttacgggcttacggaacctaacctaacgtttcgtcggttcctttaaccgttcttttaacccccg

SEQ ID NO: 375578 - DNA, 590 bp, Homo sapiens
  misc_feature: GZ8MTXP01DTWOZ.17.43.D10.1.454.CMB.2.raw
  modified_base (293)..(293): a, c, t, g, unknown or other
  modified_base (302)..(302): a, c, t, g, unknown or other
  modified_base (308)..(308): a, c, t, g, unknown or other
  modified_base (316)..(316): a, c, t, g, unknown or other
  modified_base (325)..(325): a, c, t, g, unknown or other
  modified_base (344)..(344): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtagagcagctaacttgcctggtatcgagcagaacctggccaggctccagctctcatctatggtncttccacgngggccngtgggtcnccagccagntcgaggggcaggtggtcgngggaacagtcgtcactcgtacaccatcgagcagcctgacagtctagtagttatttgacttagtttatacgtgtacgagtactaataacgtaacgtaaccgggtccgggggaccccggggggtaacgttccgggaaccgtaacggggaccgaaggggtaacgaagttacgtaacgaaaacggtacgttcggaggttccgttacggcctaacttcgttcgttcgttacctttccgaacttttcccccg

SEQ ID NO: 375579 - DNA, 633 bp, Homo sapiens
  misc_feature: GZ8MTXP01AP2JN.17.43.D10.1.454.CMB.2.raw
  modified_base (185)..(185): a, c, t, g, unknown or other
  modified_base (197)..(197): a, c, t, g, unknown or other
  modified_base (250)..(250): a, c, t, g, unknown or other
  modified_base (284)..(284): a, c, t, g, unknown or other
  modified_base (297)..(297): a, c, t, g, unknown or other
  modified_base (444)..(444): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagtcaccctgtctgtttcnccgaggggaacngccacctctcctgcagggccagtcagagtgtgagcagcaacttagcctggtancagcaagaacctggccaggctcccgaggcctccncatctagtggtcnccttcccacgaggggcccgtcgtgggtcgtccccagccaaggtacgttccggaacggggggtcctaggggttcgggggtctagggggaaactagggtaacgtttcaccttctaccgaccatcgagcacgcctgcagtctagaagttntttgacttagtttactacttgtacagtactaacttaacgtaaacgtaccgggtccgggggtaccccggggggtacgttccgggaccggtaacgggaccgtaaggggtaaggaacgactaaacgaaacggtaacgtggttcggcgttcgaaccaccgtaacttcgtcgttaccttcgttaactttccccg

SEQ ID NO: 375580 - DNA, 701 bp, Homo sapiens
  misc_feature: GZ8MTXP01DXUSO.17.43.D10.1.454.CMB.2.raw
  modified_base (286)..(286): a, c, t, g, unknown or other
  modified_base (294)..(294): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagctaacttagcctggtatcgagcaagaaacctggccaggctccgagctccncatctagnggtctccttccgaccgtagggcccgtcgtcgggtcgtcccgaggcccagtacttcggaacgggggtctaggggttcggggtccgtagggggaaaccagggtaaccgttcaaccgttcctaccaaccctatccgaagcccacgtcccgtagccgtaaggttccgtaagggttaatttagtttttcgacgttaagttttacttaaccgttggtactaaaggtactaaacgttaagtaaaccgtacgggtccccggggggtaccccgggggtaattccgggaaaccggtaaagggggacctaagggggtaacggacgaaacgttaaccggaaaacggtacggtttcggggacggccttacgggccctaaacctgtttccgtcggttaccctttccgaacgttttcccccg

SEQ ID NO: 375581 - DNA, 716 bp, Homo sapiens
  misc_feature: GZ8MTXP01DATJ4.17.43.D10.1.454.CMB.2.raw
  modified_base (184)..(184): a, c, t, g, unknown or other
  modified_base (229)..(229): a, c, t, g, unknown or other
  modified_base (315)..(315): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacagcccaccctctcctgcagggccagtcagagtgngagcagctaaacttgcctggtatcagcaagaacctggccaggctcccagctctcatctatggtcgccttccgaccgtaggggcccncgttcgggtccgtaccccgagcccgaaggtacgttccggaaggggggtccaggggttcgggggtctacgggggtaacctaagggtcgtttccaccgttccgtacccaacccgtagtccaacgggcctaggccccttggacctaaagggttcctaagggtaaagttttgttttacgtacttaagtttacttacgttagtacgtaacgtaactaaacttaaacgtaaaccgtaacccggggtcccgggggtaacccccgggggttacggttacccgggaaccggtaaacggggaaccggtaaggggtaacgaaacgttaaacgtaaacgaaacggtacggtggttacggttacttacggaacctaacgttcgttccgtacgtttccttccgttaacgttcccg

SEQ ID NO: 375582 - DNA, 600 bp, Homo sapiens
  misc_feature: GZ8MTXP01CZUH0.17.43.D10.1.454.CMB.2.raw
  modified_base (184)..(184): a, c, t, g, unknown or other
  modified_base (195)..(195): a, c, t, g, unknown or other
  modified_base (249)..(249): a, c, t, g, unknown or other
  modified_base (273)..(273): a, c, t, g, unknown or other
  modified_base (285)..(285): a, c, t, g, unknown or other
  modified_base (302)..(302): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncgaggggaacngccaccctctcctgcagggccagtcagagtgtgagcagctaacttgcctggtancagcagaactgcagctccagctcncatctatggtcncctaccgacgagggccncgtggtcgcccagccaagtcgttcggaggggctaggtggggtctggggaacaggtcgttcactctaccacatcagcagcctgcagtctagtatatttgacttagtttatacgtgtacgagtactaactaagtaaacgtaaccgggtcccgggggtacccccggggggtacgttaccgggaacccgaaacggggaccgtaaagggtaacgggaaagttaacgtaaacgaaaaccggtaacgtgggttcggcgttacgaaccgaacctaagttcctacgttaccttccgaactttccccg

SEQ ID NO: 375583 - DNA, 728 bp, Homo sapiens
  misc_feature: GZ8MTXP01EB7XT.17.43.D10.1.454.CMB.2.raw
  modified_base (184)..(184): a, c, t, g, unknown or other
  modified_base (196)..(196): a, c, t, g, unknown or other
  modified_base (253)..(253): a, c, t, g, unknown or other
  modified_base (299)..(299): a, c, t, g, unknown or other
  modified_base (420)..(420): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacngccacctctcctgcagggccagtcaggagtgtgagcagctaaacgttgcctggtacncgagacaacggaaccgtggaccgacggccctaccgagtcctcctanatctagtcggtctcctaccgacggcgggcctcgtcggtccaccgagaccgaggtacgttacgggacggggtctaggggtcgggtacgtaggggaactaggtcgttccaccttccaccacancgacgcacgcctagactagttacgtaagtaagtttgtttgaacttaagttttacttacgtcgtaacgtaacgtaacttaaacgttaaacgttaaaccgggtacccggggtcccggggggtaacccccgggggttaacgttacccggggaaaccgggtaaacggggtaaccgtaaagggggtaacggtaaacgttaaaccggtaaaccggttaaaacggtaccggttcggggttacggttccttaccgggtaaccctaaccgtttcgtttccgttacgtttaccctttaaccgttaacccgtttccccg

SEQ ID NO: 375584 - DNA, 652 bp, Homo sapiens
  misc_feature: GZ8MTXP01E46GJ.17.43.D10.1.454.CMB.2.raw
  modified_base (184)..(184): a, c, t, g, unknown or other
  modified_base (298)..(298): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacagcccacctctcctgcagggccagtcagagtgtgagcagcaacttgcctggtatcagcaagaaacctggaccaggcctcccgagcctcctcatctagtggtcnccttacccaccgtagggcccgcgtgggtcgtccccagcccaggtacgttccggaagggggtcctaggggtggggtcctagggggaaacctaggtaacgtttcccaacttccctacaacctatccgagaccacggccctggacctaggttctaggtaaagttacttttgacttagtttatactgtcagctaactagtaaacgtaaccggtccggggaccccgggggtataccgggaccgaaacggggaccgtaaggggtaagggaacgaacgtaacgaaaaccggtaagttcggacgggttcgttacggaacctaccgtaacttcgttacggttacctttccgaacgtttccccg

SEQ ID NO: 375585 - DNA, 681 bp, Homo sapiens
  misc_feature: GZ8MTXP01B5PB0.17.43.D10.1.454.CMB.2.raw
  modified_base (182)..(182): a, c, t, g, unknown or other
  modified_base (202)..(202): a, c, t, g, unknown or other
  modified_base (285)..(285): a, c, t, g, unknown or other
tcagcgtagactagcacgaccggtgctcgatttagactagcagtaaggggggaactgctcagttaggacccagacggaaccatggaagccccagcgcagcttctcttcctcctgctactctggctcccagatactactggagaaatggtgatgacgcagtctccagccacctgtctgtttcnccgaggggacagccaccctntcctgcagggccagtcagagtgtgagcagcaacttagcctggtatcagcagaactggcaggctccagctcctcatctatggtnccttccaccgagggggccctcgtgggtcgtccccgagcccagacgttcggagggggtccagggttggggtctgggggacaaggtacgttcacgtctacgacctagtcagtccagccctgctagtacgtagtaagttcttttgacttagtttactacgtgtactacgggtacttaaacgttaagtaaacgttaccggggtcccggggggtaccccccggggggttaagttacccggggaacccggtaaaacgggggtacccggtaaagggggtgggtaaaccggtaacgttaaaccgggaaaaccggttaaccggtggggttccggttacgttaccgggacccgtaacctacgttcggttaccgttccttaccgtaaccgtttccccgtttcccccg

SEQ ID NO: 375586 - DNA, 595 bp, Homo sapiens
  misc_feature: GZ8MTXP01CZMUU.17.43.D10.1.454.CMB.2.raw
  modified_base (183)..(183): a, c, t, g, unknown or other
  modified_base (310)..(310): a, c, t, g, unknown or other
  modified_base (368)..(368): a, c, t, g, unknown or other
  modified_base (382)..(382): a, c, t, g, unknown or other
  modified_base (406)..(406): a, c, t, g, unknown or other
tcagcgtagactagcacgaccggtgctcgatttagactagcagtaaggggggaactgctcagttaggacccagacggaaccatggaagccccagcgcagcttctcttcctcctgctactctggctcccagatactactggagaaatggtgatgacgcagtctccagccaccctgtctgtttcnccgaggggaacagcccaccctctcctgcagggccagtcagagtgtgagcagcaacttgcctggtatcagcagaacctggccaggctcccaggctcctcatctatggtgccttccaccgaggggcccncgtggtcgtccccagcccagacttcgagggggtcccaggtggggtctggggacaaggngttcactcgtcacntcagcagctgcagtctagaagttnttttgcttagtttactactgtacaggtctaacttaactaaacgtaaccggtccgggggacccccggggggtacgttaccgggaccgaaacgggtacccgaagggtggaagtaacgttacggaaacgttacgtaggtcggacgttcggacctaacctagtcttcgtccttactaaccttccgtaaccccg

SEQ ID NO: 375587 - DNA, 545 bp, Homo sapiens
  misc_feature: GZ8MTXP01DVG5U.17.43.D10.1.454.CMB.2.raw
  modified_base (185)..(185): a, c, t, g, unknown or other
  modified_base (196)..(196): a, c, t, g, unknown or other
  modified_base (249)..(249): a, c, t, g, unknown or other
  modified_base (279)..(279): a, c, t, g, unknown or other
  modified_base (289)..(289): a, c, t, g, unknown or other
  modified_base (305)..(305): a, c, t, g, unknown or other
  modified_base (323)..(323): a, c, t, g, unknown or other
  modified_base (343)..(343): a, c, t, g, unknown or other
  modified_base (362)..(362): a, c, t, g, unknown or other
  modified_base (390)..(390): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacngccaccctctcctgcaggggccagtcagagtgtgagcagcaattgcctggtancagcagaacctggccaggctccagctcctnatctatggtnccttccacgagggccngtgggtctcccagccagnttcgaggggcaggtgggtcnggggaacagtgttcactcncaccatcagcagcctgcagtctagaatntttgcttaagtttattactgtcagtctaagtaataagtaccgtcggggaccccgggggtagtcggaccgaaggggtaccaagggtgagacgtacgaaaacggtactggttcggcttaggcaacctaagttcgtcgttactttccaacgtttcccg

SEQ ID NO: 375588 - DNA, 787 bp, Homo sapiens
  misc_feature: GZ8MTXP01CFG1Z.17.43.D10.1.454.CMB.2.raw
  modified_base (183)..(183): a, c, t, g, unknown or other
  modified_base (193)..(193): a, c, t, g, unknown or other
  modified_base (205)..(205): a, c, t, g, unknown or other
  modified_base (223)..(223): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctccagatactactggagaaatggtgatgacgcagtctccagccacctgtctgtttcncgagggaacngcccacctctcngcaggccagtcagagtgngagcagctaacgttgcttggtatcgagcaagaaacctggaccaggcctaccgaggcctcctcaattctagtgggtctccgttcccgaaccgcggggcccgtcgttcgggttcgtcccgagacccgtaaggtacgtttaccgggacgggggtcctaggggttcggggtcgtacgggggaaacctaaggttcgttaccaaaccgttcccgtaccgaaaccctagtaccgaacgtaccgaacggacccgttggacccgtaagttacggtaacgttaaagggtttattttacgtaaccgttaaggtttttaacttacgttacgttacggtaacggttaacctaaacgtttaaacggttaaaccggttaaacccggggttaccccgggggtacccccggggggtaaaccgtttaccgggggaaacccgggtaaaccggggtaacccggttaaaggggtaaccggggaaacgttaaaccgttaaaccgaaaacgggttaacggtacggttaccggcgttacgaaccgtacctaacgttctcggtttaccttaacgttaaccctttccccg

SEQ ID NO: 375589 - DNA, 603 bp, Homo sapiens
  misc_feature: GZ8MTXP01DDE04.17.43.D10.1.454.CMB.2.raw
  modified_base (185)..(185): a, c, t, g, unknown or other
  modified_base (391)..(391): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagccaccctctcctgcagggccagtcagagtgtgagcagcaacttagcctggtatcagcagaaacctggccaggctcccaggctcctcatctatggtgcttccaccagggccgctggtcgtcccacgccagattttcgacggggcaggtgggtcgtggggaacaggtgttcacgtctcaccactcagcagcctgcngttacaggtaagtattttgctagtttattacttggtcagtactaacttaataaacgtaacggtcggggaccccggggggtacgttccgggaccgtaacggggaccgtaagggaagggtaagacgtaaccgaaacggtaaccgtggttacgggttcgttcgggtcccaaaccgtaagttccgtacggttccttaacgttaacttttcccccgg

SEQ ID NO: 375590 - DNA, 909 bp, Homo sapiens
  misc_feature: GZ8MTXP01BA30T.17.43.D10.1.454.CMB.2.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttgcctggtatcagcagaacctggccaggctcccgaggctcctctatctagtgggtctccttaccccgaccgacggggtccccgtcgttcgggttcgtacccccgaggccccgtaaggtacgtttaccgggacgggggtccgtaaggggttcgggggttccgtagggggaaacctagggtcggtttaccaacccgttcctaccaacccgtactaccgaggtcccgtaacggtccccttagggacctacgggtttacccgtttaaagggtaaaacggtttttttacgtttttaccgggtaacttttaaacgtttttaaaccgttaacggtttaccggttaaaccggtaaacggtttaacccgtttaaaaaaccgggttttaaaaccgggttttaaaacccggggttaacccccggggggttacccccgggggggggggttaaaccccccgggggggtttaacgttaaccccgggggtaaacccggggtaaaacgggggtaaacccggttaaaggggggtaaccgggtaaacggttaaaccgggttaaaacccggttaaaacgggttccggttacggggttacccgggttacccgttaccggtaaccccgttaccgttaacggtttcccgtttaccggtttaccctttcccggttaaccccgtttcccccg

SEQ ID NO: 375591 - DNA, 558 bp, Homo sapiens
  misc_feature: GZ8MTXP01A8ROW.17.43.D10.1.454.CMB.2.raw
  modified_base (185)..(185): a, c, t, g, unknown or other
  modified_base (196)..(196): a, c, t, g, unknown or other
  modified_base (281)..(281): a, c, t, g, unknown or other
  modified_base (293)..(293): a, c, t, g, unknown or other
  modified_base (309)..(309): a, c, t, g, unknown or other
  modified_base (373)..(373): a, c, t, g, unknown or other
  modified_base (377)..(377): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacngccacctctcctgcagggccagtcagagtgtgagcagcaacttgcctggtatcagcagaaacctggccaggctcccgaggcctcncatctatggtcncttcccacgagggccngtggtcgcccagccagtacttcgacggggcaggtgggtctggggaacagtcgttcactctcacntcancagcctgcagtctagattattgacttagttactatgtcagctaattacgtaaagtaccggtccgggggacccccgggggtacgttccggaccggtaaacgggaccgaagggtaaggaagttacaacgaaacgaacgttggacggcttacggcaacctgtcgtgttcctcgttaacttcccg

SEQ ID NO: 375592 - DNA, 695 bp, Homo sapiens
  misc_feature: GZ8MTXP01BJ097.17.43.D10.1.454.CMB.2.raw
  modified_base (184)..(184): a, c, t, g, unknown or other
  modified_base (246)..(246): a, c, t, g, unknown or other
  modified_base (276)..(276): a, c, t, g, unknown or other
  modified_base (283)..(283): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncgagggacagccacctctcctgcagggccagtcagagtgtgagcagctaacttgcctggtancagcaagaactggcaggcctccgagctctnatctagngtcgtccttcccgacgtacgggcctcgttcgggtccgtccgacgaccgaaggtcgttaccgggaagggggtcctaggggttcgggggtacgtacggggaaactaggttcgttcctaaaccgttccgtaccgaacctacgtacgaacggcctacgtcccgtagggccctaaaggttccgttaaagtaaggtttttacgtttacgacgtttaagtttacttacgtagtacgtaaacgtacgttaaacgttaaacggtaaaccggtaccccggggtaccccggggggtaccccggggttaacgtaccgggaaaccggtaaacggggtacgtaagggtaaggaacgttaacgtaacgaaacgtcgtcgttacgttacgcgtaactacttcgttcgttcttacctcgttccgtcccg

SEQ ID NO: 375593 - DNA, 549 bp, Homo sapiens
  misc_feature: GZ8MTXP01CWD1P.17.43.D10.1.454.CMB.2.raw
  modified_base (185)..(185): a, c, t, g, unknown or other
  modified_base (196)..(196): a, c, t, g, unknown or other
  modified_base (250)..(250): a, c, t, g, unknown or other
  modified_base (281)..(281): a, c, t, g, unknown or other
  modified_base (292)..(292): a, c, t, g, unknown or other
  modified_base (301)..(301): a, c, t, g, unknown or other
  modified_base (306)..(306): a, c, t, g, unknown or other
  modified_base (312)..(312): a, c, t, g, unknown or other
  modified_base (320)..(320): a, c, t, g, unknown or other
  modified_base (352)..(352): a, c, t, g, unknown or other
  modified_base (361)..(361): a, c, t, g, unknown or other
  modified_base (367)..(367): a, c, t, g, unknown or other
  modified_base (371)..(371): a, c, t, g, unknown or other
  modified_base (400)..(400): a, c, t, g, unknown or other
  modified_base (535)..(535): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggaagaaatggtgatgacgcagtctccagccacctgtctgtttcncgaggggaacngccacctctcctgcagggccagtcagagtgtgagcagctaacttagcctggtancagcaagaacctggccaggctccaggctccncatctatggtnccttcacgnggccntggtcnccagcagnttcgaggggcaggtgggtcaggggaactaggnttccactcncaaccntcancacgcctgcagtcgtagtaagttatttgnttatttattactgtacgagtactaactaataaacgtaaccggtccgggggacccgggggtacgtaccggaccggaacgggaacgaagggaaggaagagaacgaaacgtaacgtgttcggcttcgcacgtctcgtnttcttcttcgtccg

SEQ ID NO: 375594 - DNA, 857 bp, Homo sapiens
  misc_feature: GZ8MTXP01A3EHP.17.43.D10.1.454.CMB.2.raw
  modified_base (184)..(184): a, c, t, g, unknown or other
  modified_base (196)..(196): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacngccacctctcctgcagggccagtcagagtgtgagcagcaacttagcctggtatcagcaagaaacctggccaggcctccgaggcctcctcatctagtcggtcgtccttccgaaccgacgggggtcccgtcgttcgggttccgtccccgaaggtcccgtaaggtacgtttccggaacggggggtcctaggggttcgggggtccgtaggggggaaaaccctagggttaacggtttcccaacccgttccgtacccaacccgtagtaccgaacgacccgtaacgtcccgtacggtaccgtacggttaccgttaacgggtaaaggtttacgtttttacggaccgtttaaaggtttttaactttaaccgttacggttaccgtaacgggttaccttaaaccgtttaaacggttaaaacccggtttaaccccggggttacccggggggtaacccccccgggggggggtttaaacgtttaccccgggggtaaaccccgggtaaaacggggggtaaccccggtaaaagggggttaacgggtaaacggttaaaccggttaaacccggaaaaccgggtaaaccggtttcggggttaccggttaccgttacgggaacccttaacccgtaacgtttcccgtacggtttcccttaaccgttaaccgttttcccccgg

SEQ ID NO: 375595 - DNA, 631 bp, Homo sapiens
  misc_feature: GZ8MTXP01ACLEN.17.43.D10.1.454.CMB.2.raw
  modified_base (183)..(183): a, c, t, g, unknown or other
  modified_base (193)..(193): a, c, t, g, unknown or other
  modified_base (202)..(202): a, c, t, g, unknown or other
  modified_base (225)..(225): a, c, t, g, unknown or other
  modified_base (296)..(296): a, c, t, g, unknown or other
  modified_base (452)..(452): a, c, t, g, unknown or other
tcagcgtagactagcacgaccggtgctcgatttagactagcagtaagggggaggaactgctcagttaggacccagacggaaccatggaagcccagcgcagcttctcttcctcctgctactctggctcccagatactactggaagaaatggtgatgacgcagtctccagccacctgtctgttcncgaggggacncgccacctntcctgcagggccagtcagagtgngagcagactaacgttgcctggtatcagcagaaactggccaggcctcccaggcctcctcactctagtggtcnccttacccgacgacgggggcccgtacgtcgggtcgtcccgagtcccgaaggtcgttaccgggacgggggtctaggggtcggggtcgtagggggaaccctaggtcggtttccacgtcctaccacatcagtcacgccttgcctagttactagaagttntttgacttagtttatacgtgtacagtctaacttaagtaacgtaccgggtccgggggtaccccggggggtacgtaccgggacggtaaaccggggtacgaaggggtaaggagttaacgtacgaaaggtacgtggaggcttcggaactccgtaatcggttcgttccttcttaacgtttcccg

SEQ ID NO: 375596 - DNA, 592 bp, Homo sapiens
  misc_feature: GZ8MTXP01ERET6.17.43.D10.1.454.CMB.2.raw
  modified_base (183)..(183): a, c, t, g, unknown or other
  modified_base (193)..(193): a, c, t, g, unknown or other
  modified_base (245)..(245): a, c, t, g, unknown or other
  modified_base (285)..(285): a, c, t, g, unknown or other
  modified_base (300)..(300): a, c, t, g, unknown or other
  modified_base (318)..(318): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccacctgtctgtttcnccaggggacngccacctctcctgcagggccagtcagagtgtgagcagcaacttgcctggtancagcagaaacctggccaggctccaggctctcatcatggtncttccacgagggccngtggtctcccagccagtntcgaggggcaggtggtctggggaaacaggtgttcacgtctacacatcagcagcctgcagtctagaagttatttgacttagtttatactgtacagtctaactaagtaaacgtaaccggtcggggtaccccggggggtattaccgggaccggtaaacggggaccgtaaaggggtaacggtaagttaacgtaaccggttaaaacgtacggtcggttacgggcttacgggaactaacccgtaacgttaccgtcgttaccttaacgttaaccgttcccg

SEQ ID NO: 375597 - DNA, 648 bp, Homo sapiens
  misc_feature: GZ8MTXP01B05ZU.17.43.D10.1.454.CMB.2.raw
  modified_base (184)..(184): a, c, t, g, unknown or other
  modified_base (194)..(194): a, c, t, g, unknown or other
  modified_base (286)..(286): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncaggggaacngccacctctcctgcagggccagtcagagtgtgagcagctaacttgcctggtatcagcagaacctggccaggctccagctctcatctatggtnccttccaccgagggcctcgtcgggtctccccgagcccagtacgttccgaagggggcctagggttcggggtacgtgggggaaaccagggtaacgtttcgaaccttccgtaccaccgatcgagtcacgcctgactacgtcgtagaagttatttaggacttaacgtttacttaacttgtacgtaagtactaacttaattaacgtaaccggtccgggggtacccccggggggtaacgttcccggggaacccggtaaacgggggtacccgtaaggggtaacggaacggttaacgttaacccgaaacggtacgtagggttcggttcgttacgtcacccgtaattcgtacgttcctcttaacgttcccg

SEQ ID NO: 375598 - DNA, 709 bp, Homo sapiens
  misc_feature: GZ8MTXP01BWLWT.17.43.D10.1.454.CMB.2.raw
  modified_base (184)..(184): a, c, t, g, unknown or other
  modified_base (195)..(195): a, c, t, g, unknown or other
  modified_base (207)..(207): a, c, t, g, unknown or other
  modified_base (224)..(224): a, c, t, g, unknown or other
  modified_base (255)..(255): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggaagaaatggtgatgacgcagtctccagccacctgtctgttcncgaggggaacncgccacctctcngcgacgggccagtcagngtgtgagcagacaacgttagccttaggtacncagacaacggaaaccgtcggaccacggccctcccgagtcctcctctacttcgtagttcggtaccgtccttaccccggaccggtacggggtccccgtcggtttccgggtaccggttaccccgaggccctaaggtacgttacgggacgggggtcaggggttgggtacgcggggaactacgggtcgttcacgtcctaccacgtagccaagccgacgtccgtgccgttaaggtctaggtaacgtttactttcgggtattaacggttttactaacgttcgaacgtacgtacttaaacgttaacggtaaaccggtaacccggggtccccggggggtacccgggggtaacgttcccggggaacgggaaacggggtacgaagggggtcgaaacgcgttaaacgacgtaacgtggaggttcacgtaactacctggttccctgtttccctaagttcccttcccg

SEQ ID NO: 375599 - DNA, 673 bp, Homo sapiens
  misc_feature: GZ8MTXP01BNDX4.17.43.D10.1.454.CMB.2.raw
  modified_base (184)..(184): a, c, t, g, unknown or other
  modified_base (194)..(194): a, c, t, g, unknown or other
  modified_base (222)..(222): a, c, t, g, unknown or other
  modified_base (226)..(226): a, c, t, g, unknown or other
  modified_base (249)..(249): a, c, t, g, unknown or other
  modified_base (442)..(442): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggaagaaatggtgatgacgcagtctccagccacctgtctgttcncgagggaacngccacctctcctgcgagggccagtcagngtgngagcagactaacgttgctggtancgagacaagaacctggaccaggcctccgagccttcctacattcagtcggtctccgtaccgacggcgggcctcgtggtccgtcccgagccgagtagtccggaggggtctagggtcgggtactaggggaaactaggtcgttccaactcgacacctatcgacgtcacgtcctagactacgtataaggtaacgtttnttacgatttagttactagtacgacgactaacgtaaacgtaacgtaaacccggtacccgggggtcccgggggtaacccggggttagtacccggggtaaaccggtaaacgggtaaccgtaaaggggtaacgtaaacgttaaaccgtaaaccggaaacggttacgttcgggacgttaccgttacgaaccctacgtaacgtttccgtacgttaccgttaaccgttccgttccccg

SEQ ID NO: 375600 - DNA, 740 bp, Homo sapiens
  misc_feature: GZ8MTXP01AG34K.17.43.D10.1.454.CMB.2.raw
  modified_base (183)..(183): a, c, t, g, unknown or other
  modified_base (193)..(193): a, c, t, g, unknown or other
  modified_base (222)..(222): a, c, t, g, unknown or other
  modified_base (467)..(467): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgttcnccgagggacncgccacctctcctgcgagggccagtcagngtgtgagcagactaacgttacgccgtaggtactacgagaccgaaacggtaaccgtcggacccacgggtccctacccgaggtcccttacccgtatacgttcgtaggttcgggtcctcccgttaccccgaaccgggtcgggtccccgtcgttacgggtccgtacccgagaccggaagtcgttcggaagggggtccgtagggttcgggtacgtaggggaaactagggtcgttcacctcctacacctancgacgcacgtcgtacgacgtagtacgtaagttaagttctttaggacctttagtttaactagttcgtaactagtacccgttaaagtaaacggttaaccggtaacccgggggtcccgggggttaccccgggggttaacgtacccggggaaccggtaacggggtaaccggtagggtaacggaaacggttacgaaaccggttaaacggtacgtcgggttcgacgttacggtaaccctacgtcttccgttacggttccttccgttaacgtttcccccg

SEQ ID NO: 375601 - DNA, 658 bp, Homo sapiens
  misc_feature: GZ8MTXP01ASYDU.17.43.D10.1.454.CMB.2.raw
  modified_base (373)..(373): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacaagccaccctctcctgcagggccagtcagagtgtgagcagcaacttagcctggtatcagcagaacctggccaggcctccaggcctcctcatctatggtcgtccttccccaccgcggggtcccgcgttcgggtcgtccccgagcccaggtacgttcgacgggggctagggtcgggtcgnggggaacaggtaacgttcacgtctacactatcacgcacgcctgactgttcgtaggtaacgttattttcggacttagttttaattacgttgtacgtaacgtacctaacttaacgttaaacgttaacccgggtccggggtacccccggggggtacgttaccgggtaacccggaaaggggtacccgtaaggggtcgggaacgaacgtaaccggaaacgtaaacgtgggttacggttccgttcgaaccgtaccgtaacttcgtacgttccttccgttaacgtttccccg

SEQ ID NO: 375602 - DNA, 743 bp, Homo sapiens
  misc_feature: GZ8MTXP01DMT7K.17.43.D10.1.454.CMB.2.raw
  modified_base (184)..(184): a, c, t, g, unknown or other
  modified_base (248)..(248): a, c, t, g, unknown or other
  modified_base (279)..(279): a, c, t, g, unknown or other
  modified_base (292)..(292): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggacagccacctctcctgcagggccagtcagagtgtgagcagctaacttgcctggtancagcaagaacctggccaggctccagctcctnatctagtcggtcnccttccaccgagggccgtcgtcggtccgcccaggcccaagtacgttcggaacgggggctaggggttcggggtacgtacggggaaacaggttaacggttccaaccgttctaccaacccgtatccgaaacgccgaacgtcccgtacgtacgtacgttaccgtaaggttaaacgtttagtttttacggaactttaaagtttttaactttaaccgttcggtaaccttaacggtaacccttaaacgtttaaacgttaaaaccggtttaaacccggggttcccggggggtaccccccggggggggttaaccggtttacccggggaaacccgggtaaacgggggaacccggtaaaggggtaacgggaaacggttaacgtaaaccgaaaacgtaacggtaggttcggacttacggtaaccaccgtaacttctacgttccttaaccttaacgtttccccg

SEQ ID NO: 375603 - DNA, 759 bp, Homo sapiens
  misc_feature: GZ8MTXP01ETMW6.17.43.D10.1.454.CMB.2.raw
  modified_base (192)..(192): a, c, t, g, unknown or other
  modified_base (202)..(202): a, c, t, g, unknown or other
  modified_base (281)..(281): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgttcacgagggacncgccacctcnctgcagggccagtcgagtagtgtgagcagctaacttagcctaggtatcagcagaacctggcaggcctccgagtctcctnactctagtcggtctccgttcccgacgacggggtccctcggtcggtcgtaccccaggccctaaggtacgttccgggacgggggtacctagggggttcggggtacgtcggggaaaccgtagggttaacgttccctaacgttcccaccctaaccgtacgtaccgtacgggaccctaggtccccgttaggacccgtaagttaccggttaaggttaaacgggtttttacgtttacggttaacgtttaacgtttaacttacgttaccgttaacggtaacgttaaaccgttaaacgttaaaccggttaaaccgggtcccgggggttacccggggggtaccccgggggttacgtaccggggtaaccggtaaacgggtacgggtaagggtaacggtaacgttaaacggtaaaccggttaaacggtacggtcggttcggttcgacgtaaccgtactcgttaccttcgttacctaaccgttcccgtccg

SEQ ID NO: 375604 - DNA, 713 bp, Homo sapiens
  misc_feature: GZ8MTXP01CF5V9.17.43.D10.1.454.CMB.2.raw
  modified_base (185)..(185): a, c, t, g, unknown or other
  modified_base (206)..(206): a, c, t, g, unknown or other
  modified_base (229)..(229): a, c, t, g, unknown or other
  modified_base (277)..(277): a, c, t, g, unknown or other
  modified_base (411)..(411): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcncgaggggaacacgccaccctntcctgcgaggccagtcagagtgngagcagctaacttgcctggtatcagcagaacctgccagctccagctcnatctagtcggtcaccttccaccgtagggcccgtctcgggttacgccccgagcccaggtacttcgggaacgggggtcgaagggttcggggtctagggggaaacctagggtcgtttcaacctcttaccaacctaancagcacgccgtgctacgtcgtagtaagttagtttacgtacgtttagtttaacgttacttacggtactaacgtactaaacgttaaacgttaaaccggttaacccggggtacccgggggtaccccgggggttaaccggttaccggggaaacccgggtaaacggggtaccgtaaagggggtaacggtaaacggttaaacgtaaaacggttaaaccggtaaacggttcgggttacggttccgttaccggtaaccctaccgttaacgttaccgttacgttacctttaacccgttaaccgtttccccg

SEQ ID NO: 375605 - DNA, 551 bp, Homo sapiens
  misc_feature: GZ8MTXP01DZMJ7.17.43.D10.1.454.CMB.2.raw
  modified_base (184)..(184): a, c, t, g, unknown or other
  modified_base (298)..(298): a, c, t, g, unknown or other
  modified_base (352)..(352): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccaggggacagccacctctcctgcagggccagtcagagtgtgagcagcaattgcctggtatcagcagaaactggccaggctccagctctcatctatggtgcttccacagggccnctcggtcgtcccagcccagagttccgaggggccaggtgggtctggggaacaggngttcactctacaccatcagcagcctgcagtctagaagtatttgctagtttattactgttcgaagtctaactattaaacgtaacgtcggggccccggggggtattccgggaccgaacggggaccaagggtaaggaacgatacgaaacgtacgtcgttggcgttaggcaacgtaacttcgtcgttacttcgaatttccccg

SEQ ID NO: 375606 - DNA, 554 bp, Homo sapiens
  misc_feature: GZ8MTXP02HD8HK.17.43.D10.1.454.CMB.2.raw
  modified_base (307)..(307): a, c, t, g, unknown or other
tcagcgtagactagcacgaccggtgctcgatttagactagcagtaagggggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggcctcctcatctatggtgcttccaccaggggccnctggtcgtcccagcccagattcgaggggccaggtgggtctggggacaggagttcactctcaccatcagcagcctgcagtctgaagtatttgctagtttatacttgtcagctactataataaccgtcggggacccccggggggtacgttccgggaccgaacggggacccgaaaggggtcggaacgacgtacgaaaacgaacgtggtacggactggacaaccgatcgtcgttcttcacttccttccccg

SEQ ID NO: 375607 - DNA, 581 bp, Homo sapiens
  misc_feature: GZ8MTXP02I5ZT5.17.43.D10.1.454.CMB.2.raw
  modified_base (356)..(356): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggaacagccacctctcctgcagggccagtcagagtgtgagcagcaacttagcctggtatcagcagaaacctggccaggctcccaggcctcctcatctatggtgcttcccaccgaggggccgctgggtctcccagccagattcgaggggcaggtgggtctgggacagngttcactctcaccatcagcagcctgcagtctagaagtattttgctagtttattactgtcagtctactattaaataaccgtcggggtacccccggggggacgttaccgggccgaaacggggacccgtaaaggggtacgggaggtaacgtacgaaaacggaaacgttggtacgggtactcggaaccaacccgtaagttaccttaggttacctttctaactttccccg

SEQ ID NO: 375608 - DNA, 518 bp, Homo sapiens
  misc_feature: GZ8MTXP02H795M.17.43.D10.1.454.CMB.2.raw
  modified_base (184)..(184): a, c, t, g, unknown or other
  modified_base (195)..(195): a, c, t, g, unknown or other
  modified_base (353)..(353): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttcnccaggggaacngccaccctctcctgcagggccagtcagagtgtgagcagcaacttagcctggtatcagcagaacctggccaggctcccaggctcctcatctatggtgcttccaccagggccgctgggtcgtcccagccagattcgaggggcagtgggtctggggacagngttcactctcaccatcagcagcctgcagtctagagtatttgctagttatactgtcagcactataatacgtcgggcccgggggtacgttcggaccgaacgggaccgaaggtcggagacgtacgaaacgaactgacgcgtagcgaccatctgtccttctacttcccg

SEQ ID NO: 375609 - DNA, 579 bp, Homo sapiens
  misc_feature: GZ8MTXP02HNZQD.17.43.D10.1.454.CMB.2.raw
  modified_base (293)..(293): a, c, t, g, unknown or other
  modified_base (301)..(301): a, c, t, g, unknown or other
  modified_base (354)..(354): a, c, t, g, unknown or other
  modified_base (363)..(363): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtcnctccacgnggccgctggtcgtcccagccagattcgacggggcaggtgggtcgtgggacagngttcactcnccacatcagcagcctcgcagtcgtagtaagtagtttagtacgtagtttatttacttgttctagtactacttaattaaagtaaacgtaccggggtaccccgggggtaccgggttaccgggtaccggaacgggaacggaacgggtacgggtacggaacgtaacgaaacgaaacgtacgtacggtacgtacgaacgacactactcgtcgttactactcg

SEQ ID NO: 375610 - DNA, 522 bp, Homo sapiens
  misc_feature: GZ8MTXP02JO9Y3.17.43.D10.1.454.CMB.2.raw
  modified_base (281)..(281): a, c, t, g, unknown or other
  modified_base (291)..(291): a, c, t, g, unknown or other
  modified_base (307)..(307): a, c, t, g, unknown or other
  modified_base (348)..(348): a, c, t, g, unknown or other
  modified_base (350)..(350): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggaacagccaccctctcctgcagggccagtcagagtgtgagcagcaacttagcctggtatcagcagaacctggccaggctcccaggctcctnatctatggtncttccaccgagggccnctggtctcccagccagattcgaggggcagtggtctgggacngngttcactctcaccatcagcagcctgcagtctagaagtatttgctagtttattactgtcagtcatataataacgtcgggaccccgggggtacgttcggaccgtaacggggaccaagggtcggagacgtacgaaaacgactgtacggctagcacactctacgtctacacttccg

SEQ ID NO: 375611 - DNA, 531 bp, Homo sapiens
  misc_feature: GZ8MTXP02I1R7E.17.43.D10.1.454.CMB.2.raw
  modified_base (349)..(349): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttagcctggtatcagcagaacctggccaggctccaggctcctcatctatggtgcttccaccaggggccgctgggtgtcccagccagattcaggggcagtgggtctgggacagngttcactctcaccatcagcagcctgcagtctagagtattttgctagtttattactgtacagtcactataactaacgtcgggaccccggggggtacgttccgggaccgaaaggggacccgaaagggtcggagaagtacgaaaacggaacgtgtacggctaggcaccatctgtcttcatttccg

SEQ ID NO: 375612 - DNA, 544 bp, Homo sapiens
  misc_feature: GZ8MTXP02FYBJL.17.43.D10.1.454.CMB.2.raw
  modified_base (308)..(308): a, c, t, g, unknown or other
  modified_base (349)..(349): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgcttccaccagggccnctggtgtcccagccagattcaggggcagtggctgggacagngttcactctcaccatcagcagcctgcagtctagaagtatttgctagtttattactgtcagctactataaataccgtgggacccccgggggtagtacggtaccgaacggaacggaacggtacgggagaagtacgtaaacgaaaccgtagttacggacgtacgaacgaaccactacgttcgtcgttacctacttccc

SEQ ID NO: 375613 - DNA, 529 bp, Homo sapiens
  misc_feature: GZ8MTXP02HHEYA.17.43.D10.1.454.CMB.2.raw
  modified_base (282)..(282): a, c, t, g, unknown or other
  modified_base (292)..(292): a, c, t, g, unknown or other
  modified_base (302)..(302): a, c, t, g, unknown or other
  modified_base (355)..(355): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggctcctnatctatggtncttccaccgngggccgctgggtcgtcccagccagattcgaggggcaggtgggtctgggacagngttcactctcaccatcagcagcctgcagtctagagtatttgctagtttattactgtcagtcactataataacgtcgggaccccgggggtacgtcggaccgaagggaccgaaggtaggacgagtacgaaaacgacgtgtacggctgaaccgacactcgtcgtcttctacttcccg

SEQ ID NO: 375614 - DNA, 590 bp, Homo sapiens
  misc_feature: GZ8MTXP02IXCMC.17.43.D10.1.454.CMB.2.raw
  modified_base (295)..(295): a, c, t, g, unknown or other
  modified_base (366)..(366): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttagcctggtatcagcagaaacctggccaggctcccaggcctcctcatctatgggtcnccttcccaccgaggggcccgctcgggtcgtccccagccagacttcgacggggcaggtgggctggggacagngttcactctcaccatcagcagcctgcagtctagtaagtatttgacttagtttacttacgtgtacagtctaacttaataaacgtaaccgtccgggggacccccggggggtagttccgggaccggaaaggggaccgtaagggtacggaagacgtaacgaaaacggtacgttcggacggtactaggaaccgtaactacgttcgtagttcctttactacgtttccccg

SEQ ID NO: 375615 - DNA, 573 bp, Homo sapiens
  misc_feature: GZ8MTXP02JTH0A.17.43.D10.1.454.CMB.2.raw
  modified_base (313)..(313): a, c, t, g, unknown or other
  modified_base (363)..(363): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggcctcccaggcctcctcatctatggtgccttccaccgaggggcccncgttgggtcgtcccagccagattcgaggggcaggtgggtctggggacagngttcactctcacatcagcagcctgcagtctagaagtattttgcttagtttattactgtacagtactaactataaactaaccgtccgggggtacccccggggggtacgttccgggaccggtaaggggacccgaagggtcggaagacgtacgaaaacgtaacgtcggtacggctcggccaaccgtacgttcgtcgtcttacgactttccccg

SEQ ID NO: 375616 - DNA, 564 bp, Homo sapiens
  misc_feature: GZ8MTXP02H3CWZ.17.43.D10.1.454.CMB.2.raw
  modified_base (294)..(294): a, c, t, g, unknown or other
  modified_base (309)..(309): a, c, t, g, unknown or other
  modified_base (353)..(353): a, c, t, g, unknown or other
  modified_base (391)..(391): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctcagccaccctgtctgtttctccgaggggaacgagccaccctctcctgcagggccagtcagagtgtgagcagcaacttagcctggtatcagcagaaacctggccaggctcccaggctcctcatctatggtncttccacgagggccnctggtctcccagccagatcgaggggcaggtgggtctgggacagngttcactctcaccatcagcagcctgcagtctagaagtnttttgacttagtttattacgttgtacagctaactataataacgtcggggaccccgggggtacgtccggaccgtaacggggaccgtaagggtacggaaggacgtacgaaaacggaacgttaggtacggtcgtacggaaccaccgtaacttcgtacgttctttacgtacttcccg

SEQ ID NO: 375617 - DNA, 551 bp, Homo sapiens
  misc_feature: GZ8MTXP02HAHKL.17.43.D10.1.454.CMB.2.raw
  modified_base (204)..(204): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctntcctgcagggccagtcagagtgtgagcagcaacttgcctggtatcagcagaaacctggccaggctcccaggctcctcatctatggtgcttccaccagggccgctgggtcgtcccagccagacttcagggggcaggtgggtctggggacagagttcactctcaccatcagcagccctgcagtctgaagattttgctagtttattactgtcagtcactataataacgtcgggaccccgggggacttcgggaccgtaacggggaccaaggggttacggagaacgtaccgaaaacgtaaccgtggtacggcgtacggaacgtaccgtatcttggtccttacactttccccg

SEQ ID NO: 375618 - DNA, 559 bp, Homo sapiens
  misc_feature: GZ8MTXP02JLKAS.17.43.D10.1.454.CMB.2.raw
  modified_base (264)..(264): a, c, t, g, unknown or other
  modified_base (272)..(272): a, c, t, g, unknown or other
  modified_base (278)..(278): a, c, t, g, unknown or other
  modified_base (281)..(281): a, c, t, g, unknown or other
  modified_base (287)..(287): a, c, t, g, unknown or other
  modified_base (292)..(292): a, c, t, g, unknown or other
  modified_base (372)..(372): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccaggggaacagccaccctctcctgcagggccagtcagagtgtgagcagcaacttgcctggtatcagcagaactgcagcnccagctcnatctangtnctcacnggccnctgtctccagccagactcgacggggcaggtggtctgggacagtgtcactctacaccatcagcagctgcagtctagaagtntttgactagtttattacgtgtacagtctaactaataaagtaacgtcgggggtacccccgggggtaagttccgggaccgaaacggggaccgtaaagggtcggaaagtacgtaaccgaaaacggtaaacgtggtacggtcgtacggtaaccaacccgtagtcccgtagtccctttacgacgtttccccg

SEQ ID NO: 375619 - DNA, 578 bp, Homo sapiens
  misc_feature: GZ8MTXP02JA1WS.17.43.D10.1.454.CMB.2.raw
  modified_base (376)..(376): a, c, t, g, unknown or other
  modified_base (416)..(416): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttgcctggtatcagcagaaacctggccaggcctcccaggcctcctcatctatggtgccttcccaccgaggggcccgtcgttcgggtcgtccccgaggcccagtattccgagggggcagggtgggtcgtggggacagngttcactctacaccagtcagcagcctgcagtctagaagtnttttgcttagtttattactgtcagtctatataagtacgtcggggaccccgggggtagttccgggaccgtaacggggaccgaagggtcggaagtacgtaccgaaaacggtacgtggtacggtctacggccaccgtagttaccgtgttaccttcactttccccg

SEQ ID NO: 375620 - DNA, 574 bp, Homo sapiens
  misc_feature: GZ8MTXP02FV4LS.17.43.D10.1.454.CMB.2.raw
  modified_base (225)..(225): a, c, t, g, unknown or other
  modified_base (353)..(353): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccaggggacagccacctctcctgcagggccagtcagagtgngagcagcaaacttgcctggtatcagcagaacctggccaggctcccagctcctcatctatggtctcttccaccgagggccgctgggtcgtcccagccagacttcgacggggcaggtggtctgggacagngttcactctacaccatcagcagcctgcagtctagaagttatttgctagtttattactgtcagtacacttaataaacgtaaccgtcggggacccccgggggtacgttaccgggaccgaaacggggaccgaaagggtacggagaaacgtaacgaaaacggtaaacgtggtacggtacgtacggaaccgtaaccgagttactcggttaccttctactttccccg

SEQ ID NO: 375621 - DNA, 568 bp, Homo sapiens
  misc_feature: GZ8MTXP02F8B5H.17.43.D10.1.454.CMB.2.raw
  modified_base (361)..(361): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgccttccaccgaggggcccgcgtggtcgtccccagccagattcgaggggcaggtgggtctggggacagngttcactctcaccatcagcagcctgcagtctagaagtatttgctagtttattactgtcagcaacttaataataaccgtcgggggacccccggggggtacgttcgggaccgaaaggggaccgaaagggtacggaagaagtacgaaaacggtaacgtggtacgggcctaggaaccgtaccaagttcgtagttccttactactttccccg

SEQ ID NO: 375622 - DNA, 545 bp, Homo sapiens
  misc_feature: GZ8MTXP02HSHI3.17.43.D10.1.454.CMB.2.raw
  modified_base (358)..(358): a, c, t, g, unknown or other
  modified_base (360)..(360): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggcctcctcatctatggtgccttccaccgaggggcccgctgggtcgtcccagccagattcgaggggcaggtgggtctggggacngngttcactctccacatcagcagcctgcagtctagaagtatttgctagtttatactgtacagtctacttataatacgtccggggaccccgggggtacgttccgggaccgaaggggaccgaagggtggaagagtaacgaaacggaacgtggtcggactgaacacctagtcctgtccttcactttcccg

SEQ ID NO: 375623 - DNA, 597 bp, Homo sapiens
  misc_feature: GZ8MTXP02FL1KY.17.43.D10.1.454.CMB.2.raw
  modified_base (294)..(294): a, c, t, g, unknown or other
  modified_base (303)..(303): a, c, t, g, unknown or other
  modified_base (309)..(309): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcaagaacctggccaggctcccaggctcctcatctatggtncttccaccngggccnctgggtctcccagccagacttcgacggggcaggtgggtctggggacaggtgttcactctacacatcagcagcctgcagtctagaagtattttgcttagtttattacgtgtactagtctaactttaataaacgttaacccggttccgggggacccccggggggttagtttacccggggaaccgtaaacgggggtacccgaaaaggggttcgggaacgacgttaaccgaaaacggtacggttacgtcgggcttcggaaccgacctattcgtcgttacttctacttccccg

SEQ ID NO: 375624 - DNA, 530 bp, Homo sapiens
  misc_feature: GZ8MTXP02GH7N2.17.43.D10.1.454.CMB.2.raw
  modified_base (291)..(291): a, c, t, g, unknown or other
  modified_base (307)..(307): a, c, t, g, unknown or other
  modified_base (356)..(356): a, c, t, g, unknown or other
  modified_base (365)..(365): a, c, t, g, unknown or other
  modified_base (520)..(520): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggctctcatctatggtncttccaccgagggccnctgggtctcccagccagacttcgacggggcaggtgggtctggggacagngttcactcncaccatcagcagcctgcagtctagagtattttgctagtttattactgtcagtcactataactaacgtcggggacccccggggggtacgttccgggaccgaacggggaccgaagggtcgggaagagtacgaaaacgacgtcgaggctgcacatctntctctactcg

SEQ ID NO: 375625 - DNA, 535 bp, Homo sapiens
  misc_feature: GZ8MTXP02IZ557.17.43.D10.1.454.CMB.2.raw
  modified_base (276)..(276): a, c, t, g, unknown or other
  modified_base (346)..(346): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaactggccaggctccagcnctcatctatgtgcttccaccagggccgctggtcgtccagccagattcgaggggcagtggtctgggacagngttcactctcaccatcagcagcctgcagtctagagtatttgactagtttattactgttacagtacaacttataaactaaccgtcggggtaccccgggggacgttcggaccgaagggaccgaagggtacggaggtacacgaaacgtaaacgtgtaggctagaacgaccaagtctgtccttacactttccc

SEQ ID NO: 375626 - DNA, 517 bp, Homo sapiens
  misc_feature: GZ8MTXP02GO2SV.17.43.D10.1.454.CMB.2.raw
  modified_base (292)..(292): a, c, t, g, unknown or other
  modified_base (353)..(353): a, c, t, g, unknown or other
  modified_base (506)..(506): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttgcctggtatcagcagaaacctggccaggctcccaggcttctcatctatggtncttccaccagggccgctgggtgtcccagccagattcgaggggcagtgggtctggggacagngttcactctcaccatcagcagccctgcagtctgaagattttgctagtttattactgtctagcactataataacgtcgggacccccgggggagttcgggaccgaagggaccaagggtcggagatacgaaaacgactgtacggctagcaccatcngtctcacttcc

SEQ ID NO: 375627 - DNA, 539 bp, Homo sapiens
  misc_feature: GZ8MTXP02FVJMK.17.43.D10.1.454.CMB.2.raw
  modified_base (360)..(360): a, c, t, g, unknown or other
  modified_base (398)..(398): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgccttccaccgagggcccgctgggtctccccgagccagattcgaggggcaggtgggtctggggacagngttcactctcaccatcagcagcctgcagtctagaagtntttgctagtttattactgtcagctaactataaataaccgtcgggaccccgggggtacgttccggaccgaaaggggaccgaagggtcggaagatacgaaaacgaacgtgtacgcgtagcaccgatctgtcttcactttcccg

SEQ ID NO: 375628 - DNA, 601 bp, Homo sapiens
  misc_feature: GZ8MTXP02JONER.17.43.D10.1.454.CMB.2.raw
  modified_base (297)..(297): a, c, t, g, unknown or other
  modified_base (421)..(421): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagcccaccctctcctgcagggccagtcagagtgtgagcagcaacttagcctggtatcagcagaaacctggccaggcctcccgaggcctcctcatctatggtncttccaccgagggccgcgtgggtcgtcccagccagtacttcgacggggtcagggtcggggtctggggaacaggtagtttccacgttcctacacctatcagccagccctagctagtctagaagtntttgcttagtttattactgtacagtctaataataacgtaacggtccgggggaccccgggggtagttccgggaccgtaaggggaccgaaagggtcggaagtacgtaaccgaaaacggtacgtacggtacggtacgtacggaacctaaccgtattccgtacgttcctttacgactttccccg

SEQ ID NO: 375629 - DNA, 606 bp, Homo sapiens
  misc_feature: GZ8MTXP02HKCYD.17.43.D10.1.454.CMB.2.raw
  modified_base (184)..(184): a, c, t, g, unknown or other
  modified_base (195)..(195): a, c, t, g, unknown or other
  modified_base (295)..(295): a, c, t, g, unknown or other
  modified_base (312)..(312): a, c, t, g, unknown or other
  modified_base (384)..(384): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggacngccacctctcctgcagggccagtcagagtgtgagcagcaacttgcctggtatcagcagaacctggccaggcctcccgaggcctcctcattctatgggtcnccttccaccgagggccncgtcgggtctcccagccagtacttcggaggggcaggtgggtctggggacaggtcgttcactctaccacctancagcacgcctgctagtcgtagtaagttagtttgacttagtttacttacgtgtacagtactaattaataaacgtaccgggtcccgggggtaccccgggggtacgtaccgggaccggaaacggggacgtaaggggtacggaacgtaaacgtaaaccgaaaacggtacgtcggtacgacgtacgaaccgtacgtacgttcgtacgttccttacttaccgttcccg

SEQ ID NO: 375630 - DNA, 573 bp, Homo sapiens
  misc_feature: GZ8MTXP02I7JQB.17.43.D10.1.454.CMB.2.raw
  modified_base (292)..(292): a, c, t, g, unknown or other
  modified_base (308)..(308): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttgcctggtatcagcagaacctggccaggctcccaggctcctcatctatggtncttccaccgagggccnctgggtctcccagccagattcgaggggcaggtgggtctggggacaggtgttcactctcaccatcagcagcctgcagtctagagtatttgctagtttattacgtgtcagtacacttaataaataaccgtcggggtacccccggggggtagttccgggaccgtaacggggaacccgaagggtacggagaacgtacgaaaacggtaacgtcggtacggccgtaggaacctaacccgtagttcctcgttaccttactaacgtttccccg

SEQ ID NO: 375631 - DNA, 549 bp, Homo sapiens
  misc_feature: GZ8MTXP02G779C.17.43.D10.1.454.CMB.2.raw
  modified_base (393)..(393): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttagcctggtatcagcagaaacctggccaggctcccaggctcctcatctatggtgcttccaccgagggccgctggtcgtcccagccagattcgaggggcaggtgggtctgggacagagttcactctcaccatccagcagcctgcagtctagaagtntttgctagtttattactgtcagctaatataaataacgtcggggcccccgggggtaacgttccgggaccgaaacggggaccgaaaagggtgggaaacgtactaacgaaaacgaacgttaggacggctaggaaccacacgtctagtcttcactttccc

SEQ ID NO: 375632 - DNA, 542 bp, Homo sapiens
  misc_feature: GZ8MTXP02HVHT9.17.43.D10.1.454.CMB.2.raw
  modified_base (184)..(184): a, c, t, g, unknown or other
  modified_base (201)..(201): a, c, t, g, unknown or other
  modified_base (273)..(273): a, c, t, g, unknown or other
  modified_base (285)..(285): a, c, t, g, unknown or other
  modified_base (299)..(299): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncaggggacagccacctntcctgcagggccagtcagagtgtgagcagcaacttgcctggtatcagcagaacctggcaggctccaggctcnatctagtggtcnctccacgagggccnctgggtctcccagccagatcgaggggcaggtggctgggacagtgttcactctcaccatcagcacgcctgcagtcgtagaagtattttgacttagtttattactgttcagctaactataaacgtacggtcgggaccccgggggtacgttacgggacgtaacgggacgaaaggtggaacgacgtacgaaaacgtaacgtgacgtccgtagaacgaccagttctacgttccttactacgtttcccg

SEQ ID NO: 375633 - DNA, 602 bp, Homo sapiens
  misc_feature: GZ8MTXP02HKCOG.17.43.D10.1.454.CMB.2.raw
  modified_base (285)..(285): a, c, t, g, unknown or other
  modified_base (296)..(296): a, c, t, g, unknown or other
  modified_base (312)..(312): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttagcctggtatcagcagaaacctggccaggcctcccaggcctcncatctatggtncttccaccgagggccncgtgggtcgtcccgagcccagacttcggaggggcagggtcgggtcgtggggacagggtacgtttcaacttcctacaacctatccagcacgccctgcagtctagaagtactttgacttagtttacttactgtacagtacaacttaataaacgtaaccggttaccgggggacccccggggggtacgttccggggaccgaaacggggaaccgaaagggtcggaagtacgtacgaaaacgtaacgtaggtacggactcggaacgaccgtactcgtacgtcttactacttccccg

SEQ ID NO: 375634 - DNA, 582 bp, Homo sapiens
  misc_feature: GZ8MTXP02GPV4Z.17.43.D10.1.454.CMB.2.raw
  modified_base (297)..(297): a, c, t, g, unknown or other
  modified_base (314)..(314): a, c, t, g, unknown or other
  modified_base (400)..(400): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttgcctggtatcagcaagaaacctggccaggcctcccgaggcctcctcatctatgggtnccttccaccgagggccnctggtctcccagccagattcgaggggcaggtgggtctggggacaggtcgttcacgtctcaccatcagcagccctgcagtctagatntttgacttagtttattactgtacagtactactaataaagtaaccggtccgggggacccccgggggtagttcccgggaccggaaacggggaaccgtaaggggtacggagtaactaacgaaaacgtacgtaggtacggcgtacgaaccgtaacctagttcctgttaccttacgtactttccccg

SEQ ID NO: 375635 - DNA, 559 bp, Homo sapiens
  misc_feature: GZ8MTXP02JITVT.17.43.D10.1.454.CMB.2.raw
  modified_base (185)..(185): a, c, t, g, unknown or other
  modified_base (282)..(282): a, c, t, g, unknown or other
  modified_base (292)..(292): a, c, t, g, unknown or other
  modified_base (307)..(307): a, c, t, g, unknown or other
  modified_base (384)..(384): a, c, t, g, unknown or other
  modified_base (394)..(394): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagccaccctctcctgcagggccagtcagagtgtgagcagcaacttgcctggtatcagcagaaacctggccaggctcccaggctcctnatctatggtncttccacgagggccncgtggtctcccagccagacttcgaggggcaggtgggtctggggacagcgttcacgtctcacctatcagcagcctgcngtctagagtntttgacttagtttattactgtacagtactactaattaaacgtaccggtcgggggacccccgggggtaattccggggaccgaaggggaccgaagggtggaagataacgaaacgtaacgtggtacggctacggcgaccctagttccgtagtccttacgactttcccg

SEQ ID NO: 375636 - DNA, 629 bp, Homo sapiens
  misc_feature: GZ8MTXP02G6UY3.17.43.D10.1.454.CMB.2.raw
  modified_base (185)..(185): a, c, t, g, unknown or other
  modified_base (196)..(196): a, c, t, g, unknown or other
  modified_base (204)..(204): a, c, t, g, unknown or other
  modified_base (289)..(289): a, c, t, g, unknown or other
  modified_base (298)..(298): a, c, t, g, unknown or other
  modified_base (312)..(312): a, c, t, g, unknown or other
  modified_base (377)..(377): a, c, t, g, unknown or other
tcagcgtagactagcacgaccggtgctcgatttagactagcagtaaggggaggaactgctcagttaggacccagacggaaccatggaagcccagcgcagcttctcttcctcctgctactctggctcccagatactactggagaaatggtgatgacgcagtctacccgagccacctgtctgtttcnccaggggaacngccacctntcctgcagggccagtcagagtgtgagcagcaacttgcctggtatcagcagaaacctggccaggctccaggctctcatctatggtncttccaccnggggtttaaccccngtcggtcgtccagccagtacttcgacggggtctaggtcggtcgtgggacaggtcgttcaaccctntaccacctatcgacgcgacgtccgtcgacgtacgtcgtagtaacgtaggttttacgacgttagtttacgttacgttcgttacgtacgtactacgttaacgttaacccgtaacggtaccgggtaccccgggggtacgtaccgggtaccgtaacgggtaccgtaacgggtacggtacgtacgtaacgtaaacggtacgtacgtacggtacgtacgaaccgtacgtacgtcgtacgtaccgttacgtacgttccg

SEQ ID NO: 375637 - DNA, 561 bp, Homo sapiens
  misc_feature: GZ8MTXP02JLT6Q.17.43.D10.1.454.CMB.2.raw
  modified_base (305)..(305): a, c, t, g, unknown or other
  modified_base (312)..(312): a, c, t, g, unknown or other
  modified_base (362)..(362): a, c, t, g, unknown or other
  modified_base (401)..(401): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggcctcctcatctatggtcgcttccaccgnggggccncgtgggtcgtcccagccagactcgaggggcaggtgggtctggggacaggngttcactctcaccatcagcagcctgcagtctagtaagtnttttgacttagtttattacgtgtacagtactaacttataaataacggtccggggaccccgggggtagttccggaccgaagggtaccgaagggtcggagtactaacgaaacgacgtcgacggtctacgaactacgacttctacgtcttacctactttcccg

SEQ ID NO: 375638 - DNA, 548 bp, Homo sapiens
  misc_feature: GZ8MTXP02G5G50.17.43.D10.1.454.CMB.2.raw
  modified_base (185)..(185): a, c, t, g, unknown or other
  modified_base (279)..(279): a, c, t, g, unknown or other
  modified_base (300)..(300): a, c, t, g, unknown or other
  modified_base (306)..(306): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggacagccacctctcctgcagggccagtcagagtgtgagcagcaacttgcctggtatcagcagaacctggccaggctcccaggctcctnatctatggtgccttccaccgngggccnctgggtcgtcccagccagcttcgaggggcaggtgggctggggacaggtagttcacgtctcaccatcagcagcctgctagtctagagtatttgactagtttatactgtcatacctatataaataaccgtcggggacccccgggggtagttccgggaccgaagggtaccgaggggtagaggactacgaaacgaacgtggacgtcgacgaacgacctaagtcttcgtctttaccacgtttccccg

SEQ ID NO: 375639 - DNA, 524 bp, Homo sapiens
  misc_feature: GZ8MTXP02I9LDG.17.43.D10.1.454.CMB.2.raw
  modified_base (287)..(287): a, c, t, g, unknown or other
  modified_base (291)..(291): a, c, t, g, unknown or other
  modified_base (353)..(353): a, c, t, g, unknown or other
  modified_base (362)..(362): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttagcctggtatcagcagaaacctggccaggctcccaggctctcatctanggtncttccaccagggccgctgggtctcccagccagattcgaggggcaggtgggtctggggacagngttcactcncaccatcagcagcctgcagtctgaagtattttgctagtttatactgtcagcactataaactaacgtcgggaccccggggggtacgttcgggaccaaaggggaccaaagggtcggagagtacaaaacgaacttgacggctgcacctatctgtcttcactttcc

SEQ ID NO: 375640 - DNA, 527 bp, Homo sapiens
  misc_feature: GZ8MTXP02IBTDP.17.43.D10.1.454.CMB.2.raw
  modified_base (195)..(195): a, c, t, g, unknown or other
  modified_base (303)..(303): a, c, t, g, unknown or other
  modified_base (309)..(309): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggaacngccacctctcctgcagggccagtcagagtgtgagcagcaacttagcctggtatcagcagaaacctggccaggcctcccaggcctcctcatctatggtgccttccaccngggccnctggtcgtcccagccagacttcgacggggcaggtgggtcgtggggacagtggttcactctccaccatccaagcagcctgcagtctagagtattttgactagttattactgtacagtcactataactacgtcgggcccgggggtacgttcggacgaacgggacgaggtaggagatacgaaacgaacgtcgtacgctgcactactctgtcttcacttccg

SEQ ID NO: 375641 - DNA, 612 bp, Homo sapiens
  misc_feature: GZ8MTXP02IQCOR.17.43.D10.1.454.CMB.2.raw
  modified_base (184)..(184): a, c, t, g, unknown or other
  modified_base (292)..(292): a, c, t, g, unknown or other
  modified_base (301)..(301): a, c, t, g, unknown or other
  modified_base (307)..(307): a, c, t, g, unknown or other
  modified_base (350)..(350): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccaggggaacagccacctctcctgcagggccagtcagagtgtgagcagcaacttagcctggtatcagcagaaacctggccaggctcccaggcctcctcatctatggtncttccaacngggccnctgggtcgtccagccagattcgaggggcagtggctgggacagngttcactctacaccatcagcagctcgcagtgtagtaagtagtttagtacttagtttagtttaaacgtttacgttacgtacgtactaacttaaacgttaaacgtaaccggtacccgggggtaccccgggggtaccgggtaccgggaaccggtaaacgggaaacgggtaacgggtacgggaacggtaacgtaaacgtaaaacgtaaacggtacggtacggtacgtacgtaacgacgtactacgttacgttacttactacttccg

SEQ ID NO: 375642 - DNA, 598 bp, Homo sapiens
  misc_feature: GZ8MTXP02JV5US.17.43.D10.1.454.CMB.2.raw
  modified_base (196)..(196): a, c, t, g, unknown or other
  modified_base (228)..(228): a, c, t, g, unknown or other
  modified_base (260)..(260): a, c, t, g, unknown or other
  modified_base (281)..(281): a, c, t, g, unknown or other
  modified_base (291)..(291): a, c, t, g, unknown or other
  modified_base (300)..(300): a, c, t, g, unknown or other
  modified_base (306)..(306): a, c, t, g, unknown or other
  modified_base (352)..(352): a, c, t, g, unknown or other
  modified_base (395)..(395): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccgaggggaacngccaccctctcctgcagggccagtcagagtgngagcagcaacttgcctggtatcagcagaaccnggccaggcctcccaggctccnatctatggtncttccacgngggccncgtggtcgtcccagccagcttcgaggggcaggtgggtctggggacnggtgttcactctacaccatcagcagcctgcagtctagaagttntttgacttagtttacttacgtgtactacgactaacttaacgttaaacgtaccggtacccgggggtacccccgggggtacgtaccgggaaccggtaacggggaaccgtaaggggtacggaacgaacgtaaaccgaaaacggtacgtacgggtacggtacgtacgaaccgtacctacgtcgttacgttccttacgtaccttcccg

SEQ ID NO: 375643 - DNA, 566 bp, Homo sapiens
  misc_feature: GZ8MTXP02H6PX9.17.43.D10.1.454.CMB.2.raw
  modified_base (185)..(185): a, c, t, g, unknown or other
  modified_base (196)..(196): a, c, t, g, unknown or other
  modified_base (359)..(359): a, c, t, g, unknown or other
  modified_base (397)..(397): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacngccacctctcctgcagggccagtcagagtgtgagcagcaacttagcctggtatcagcagaaactggccaggctcccaggcctcctcatctatggtgcttccaccgagggccgcgtgggtcgtccccagccagattcgaggggcaggtgggtcgtggggacagngttcactctcaccatcagcagcctgcagtctagaagtnttttgactagtttattactgttcacgtctaactattaaagtaaccgtcgggggacccccggggggtagtttaccggggaccgtaaaggggaccgtaaggggtacggagtaacgtacgaaaacgtactagggtcgacgtgaacacgtactcgttcgtctttcactttccc

SEQ ID NO: 375644 - DNA, 758 bp, Homo sapiens
  misc_feature: GZ8MTXP02JUWDS.17.43.D10.1.454.CMB.2.raw
  modified_base (296)..(296): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggcctcccagatactactggagaaatggtgatgacgcagtctccagccaccctgtctgtttctccaggggaacagccaccctctcctgcagggccagtcagagtgtgagcagcaacttgcctggtatcagcagaacctggccaggcctcccaggcctcctcatctagtggtcnccttccacgacgggccgcgtgggtcgtcccagccctaggtacttcggacggggctagggtggggtccgtggggaaccagggtacggtttccaacgttcctaccacctagtccgaacggccacggtccctaggcgtacggttccgttaaggtaagtttaacgtttttcggaaccgtttaaggtttttaacttaccgttcggttaaccgaacggttaccctaaaacctttaacgttaaaaccgggttaaccccgggttcccccggggggggtaccccccccgggggggttaaggttacccccggggtaacccgggtaaaacgggggtaaccccggaaaagggggttacgggaaaacggtacgttaaacccggaaaaacggttaaccgtcggggttaacggggcccgttacggaacccgtaaccgttacgtccgttaccgttaccgtttaccgacctttcccccg

SEQ ID NO: 375645 - DNA, 547 bp, Homo sapiens
  misc_feature: GZ8MTXP02H7J1N.17.43.D10.1.454.CMB.2.raw
  modified_base (184)..(184): a, c, t, g, unknown or other
  modified_base (196)..(196): a, c, t, g, unknown or other
  modified_base (228)..(228): a, c, t, g, unknown or other
  modified_base (296)..(296): a, c, t, g, unknown or other
  modified_base (308)..(308): a, c, t, g, unknown or other
  modified_base (314)..(314): a, c, t, g, unknown or other
  modified_base (382)..(382): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacngccaccctctcctgcagggccagtcagagtgngagcagcaacttagcctggtatcagcagaacctggccaggcctcccaggcctcctcatctatgggtcnccttcccaccgngggccncgtgggtctcccagccagtacttcgaggggctagggtgggcgtgggacaggtgttcactctacacctntcagcagcctgcagtctagaagtattttgacttagtttatactgtcagtcatataacgtacgcggggacccgggggtatcggaccgaagggaccgaagggtagaagacgtaacgaaaacggtacgtacgcggtcagaactaccgatctagtccttactactcccg

SEQ ID NO: 375646 - DNA, 573 bp, Homo sapiens
  misc_feature: GZ8MTXP02JVW8C.17.43.D10.1.454.CMB.2.raw
  modified_base (184)..(184): a, c, t, g, unknown or other
  modified_base (283)..(283): a, c, t, g, unknown or other
  modified_base (293)..(293): a, c, t, g, unknown or other
  modified_base (370)..(370): a, c, t, g, unknown or other
  modified_base (400)..(400): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttcnccaggggaacagccaccctctcctgcagggccagtcagagtgtgagcagcaacttgcctggtatcagcagaaacctggccaggcctcccaggcctcctnatctatggtnccttccaccgaggggccgctgggtcgtccccaggcccagacttcgaggggcaggtggtctgggacagcgttcactcncaccatcagcacgcctgacagtctgaagtntttgactagtttattactgtcagtactactaataaacgtaaccgtccgggggtacccccggggggtacttccggggaccgtaaacggggaaccgaagggtacggagaacgtacgaaaacgtacgtggtacggctacggctaaccacgttcctgtaccttactactttaccccg

SEQ ID NO: 375647 - DNA, 516 bp, Homo sapiens
  misc_feature: GZ8MTXP02I905V.17.43.D10.1.454.CMB.2.raw
  modified_base (351)..(351): a, c, t, g, unknown or other
  modified_base (366)..(366): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttgcctggtatcagcagaaacctggccaggctcccaggcctctcatctatggtgcttccacagggccgctgggtcgtcccagccagattcgaggggcagtgggtctgggacagngttcactctacaccntcagcagcctgcagtctagagtatttgctagtttattactgtcagctactataatacgtcgggtccccgggggattcggaccgtaagggaccgaaggtacggagactacgaaaacgactcgtacgctagcacatctgtctcgactttccg

SEQ ID NO: 375648 - DNA, 567 bp, Homo sapiens
  misc_feature: GZ8MTXP02FNIOZ.17.43.D10.1.454.CMB.2.raw
  modified_base (291)..(291): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctccagctcctcatctatggtncttccaccgagggccgctcgggtcgtccccagccagacttcgaggggcaggtgggtctggggacagtgttcactctcaccatcagcagcctgcagtctagagtatttgctagtttattactgtacagtcaacttaataaagtaaaccgttcggggacccccggggggtacgttcccggggaccgaaacggggaccgaaagggtagggaacgtacgtacgaaaacgtaaacgtggtacggctggaaccgactacgtactcggttcttcactttcccg

SEQ ID NO: 375649 - DNA, 526 bp, Homo sapiens
  misc_feature: GZ8MTXP02G4YRA.17.43.D10.1.454.CMB.2.raw
  modified_base (276)..(276): a, c, t, g, unknown or other
  modified_base (351)..(351): a, c, t, g, unknown or other
  modified_base (390)..(390): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaactggcaggctccagctcnatctatgtgcttccacgaggccgcgtggtcgtcccagccagtacttcgacggggtcaggtgggtctgggacaggngttcactctacaccatcagcagcctgcagtctagaagtntttgctagtttattactgtcagcactataaatacgtcggggtccccgggggtacgttccgggacgaacgggacgaagggtggagtacgtacgaaacgaacgtggtacgctagcacgactctcgtcttcacttcccg

SEQ ID NO: 375650 - DNA, 499 bp, Homo sapiens
  misc_feature: GZ8MTXP02FM5C5.17.43.D10.1.454.CMB.2.raw
  modified_base (312)..(312): a, c, t, g, unknown or other
  modified_base (351)..(351): a, c, t, g, unknown or other
  modified_base (487)..(487): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgcttccaccagggccgctggngtcccagccagattcaggggcagtgggtctggggacagngttcactctcaccatcagcagcctgcagtctgaagattttgctagtttattactgtcagcactataataactggccccgggggagttcggcgaagggaccaaggtcgagatacaaacgactgtaggctgcgacacnctgtctcactcc

SEQ ID NO: 375651 - DNA, 552 bp, Homo sapiens
  misc_feature: GZ8MTXP02GXAS5.17.43.D10.1.454.CMB.2.raw
  modified_base (360)..(360): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggaacagccaccctctcctgcagggccagtcagagtgtgagcagcaacttgcctggtatcagcagaacctggccaggctcccaggctcctcatctatggtgccttccaccaggggcccgcttgggtcgtcccagccagacttcgaggggcaggtgggtcgtggggacaggngttccactctcaccatcgagcagccctgcagtctagaacgtattttgctagtttattactgtcagtctactataataacgtccggggaccccgggggtacgtcggaccgaagggtaccgaagggtagagacgtacgaaacgtacgtacgtcggactcgaaccactacgtcgtacgtctttacgactttcccg

SEQ ID NO: 375652 - DNA, 552 bp, Homo sapiens
  misc_feature: GZ8MTXP02IZ9YA.17.43.D10.1.454.CMB.2.raw
  modified_base (301)..(301): a, c, t, g, unknown or other
  modified_base (376)..(376): a, c, t, g, unknown or other
tcagcgtagactagcacgaccggtgctcgatttagactagcagtaagggggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttgcctggtatcagcagaaacctggccaggcctcccaggcctcctcatctatggtgcttccaccgnggggccgctggtcgtccccagcccagtactcgaggggccaggtgggtctggggacaggtagttcactcctcaccntcagcagcctgcagtctagatatttgcttagtttatctgtcagctatatagtacgtcggggccccgggggtagttcggacgaagggaccgagggtacggaagtactaacgaaacgtaacgtggtacgcgtcgactaaccgtacgttacgtcgttccttactacgttcccttacccg

SEQ ID NO: 375653 - DNA, 570 bp, Homo sapiens
  misc_feature: GZ8MTXP02I7QHN.17.43.D10.1.454.CMB.2.raw
  modified_base (290)..(290): a, c, t, g, unknown or other
  modified_base (301)..(301): a, c, t, g, unknown or other
  modified_base (350)..(350): a, c, t, g, unknown or other
  modified_base (353)..(353): a, c, t, g, unknown or other
  modified_base (390)..(390): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttgcctggtatcagcagaacctggccaggctcccaggctcctcatctatggtnccttccaccgngggccgctgggtcgtcccagccagattcgaggggcagtggtctgggacnggngttcactctcaccatcagcagcctgcagtctagagtntttgctagttattactgtcagctactataatacgtcgggaccccgggggtacgttccgggaccgaacggggaccgtaagggtacgggaaggtacgtaacgaaaacggtaaaccgtggtacggcgttacggaacctaacccgtagttccgttacggtttcctttaccgtacgtttcccccg

SEQ ID NO: 375654 - DNA, 546 bp, Homo sapiens
  misc_feature: GZ8MTXP02F5KT1.17.43.D10.1.454.CMB.2.raw
  modified_base (292)..(292): a, c, t, g, unknown or other
  modified_base (353)..(353): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggctcctcatctatggtncttccacagggccgctggtcgtcccagccagattcgaggggcaggtgggtctggggacagngttcactctcaccatcagcagcctgcagtctgaagtatttgctagtttattactgtcagtcactaataaactaacgtcggggacccccgggggtacgttccgggaccgaaaggggacccgaaaggggtcggaaggacgtaccgaaaacggaaacgtggtacggctaggcaccgtatctgtcttctacttcccg

SEQ ID NO: 375655 - DNA, 631 bp, Homo sapiens
  misc_feature: GZ8MTXP02HJ0JT.17.43.D10.1.454.CMB.2.raw
  modified_base (294)..(294): a, c, t, g, unknown or other
  modified_base (307)..(307): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggcctcccagatactactggagaaatggtgatgacgcagtctccagccaccctgtctgtttctccgaggggaacagccaccctctcctgcagggccagtcaggagtgtgagcagcaacttgcctggtatcagcagaacctggccaggctcccaggcctctcatctatggtnccttcccgaccgnggggcccgcgttgggtcgtccccaggcccagtacgttcgagggggcctaggggtcgggtcgtaggggacagggtcgtttcacttctccaccatcagcacgccctgcagtcgtagtaagttattttgacttagttttatacgttgttacagtactaacttaataacgtaaccggtccgggggtacccccggggggtagtttaccggggaccgtaaacgggggaccgtaaaaggggtcggaacgtaacgtaaccggaaaaacggtaacggttgggtacggacttacggaaccacctacgttctacgtttcctactaactttccccg

SEQ ID NO: 375656 - DNA, 522 bp, Homo sapiens
  misc_feature: GZ8MTXP02GUB38.17.43.D10.1.454.CMB.2.raw
  modified_base (328)..(328): a, c, t, g, unknown or other
  modified_base (397)..(397): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagcccaccctctcctgcagggccagtcagagtgtgagcagcaacttgcctggtatcagcagaaacctggccaggctcccaggcctctcatctatggtgccttccacctggggccgctggtcgtcccagccagnttcgaggggcaggtgggtctggggacagcgttcactctacaccatcagcagccctgcagtctagaagtnttttgctagtttattactgtacagtcatatataacgtcgggccccgggggtacgttcggacgtaagggaccgaaggtcggagatacgaaacgacgtgcgcgtgcactatctgtctctacttcccg

SEQ ID NO: 375657 - DNA, 618 bp, Homo sapiens
  misc_feature: GZ8MTXP02JF5K3.17.43.D10.1.454.CMB.2.raw
  modified_base (316)..(316): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagccaccctctcctgcagggccagtcagagtgtgagcagcaacttgcctggtatcagcaagaaacctggaccaggcctcccgaggcctcctcatctatggtctccttccgaccgagggccncgtcgggtctcccagccagattcggaggggcaggtcgggtcgtaggggacaggtacgttccacttccgtaccaacctatacgacgcagtccctgacctagtctagaacgttgttttgacttagtttacttactgtacagtactaacttaagtaaacgtaccgggtccgggggtaccccgggggtagttaccgggaccggtaaacggggaccgtaaaggggtcggaacgtaacgtaaaccggaaacgtacgtggtacggtcgtacgaaccgacctattcgtcgttacttacgtactttccccg

SEQ ID NO: 375658 - DNA, 615 bp, Homo sapiens
  misc_feature: GZ8MTXP02JS728.17.43.D10.1.454.CMB.2.raw
  modified_base (299)..(299): a, c, t, g, unknown or other
  modified_base (309)..(309): a, c, t, g, unknown or other
  modified_base (315)..(315): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttagcctggtatcagcaagaacctggccaggcctcccgaggcctcctcatctatggtcncttccaccgngggccncgtgggtcgtcccagccagtacttcgaggggcaggtcgggtctggggacaggtcgttcactctcacctatcagcacgcctgcagtctagtagtatttgcttagtttattacgtgtacagctaacttaagtaacgtaaccggtccgggggacccccggggggtacgttaccggggaaccggtaaacggggaaccgtaaggggtacgggaaacgacgttaaccgaaaacggtacgtagggtacggtaccgtacggaacctaacccgtagttccgttacggttcctttaccgtactttccccg

SEQ ID NO: 375659 - DNA, 532 bp, Homo sapiens
  misc_feature: GZ8MTXP02G2M9W.17.43.D10.1.454.CMB.2.raw
  modified_base (295)..(295): a, c, t, g, unknown or other
  modified_base (361)..(361): a, c, t, g, unknown or other
  modified_base (398)..(398): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaaccagccaccctctcctgcagggccagtcagagtgtgagcagcaacttagcctggtatcagcagaaacctggccaggctcccaggcctcctcatctatggtncttccaccagggcccgctgggtcgtcccagccagacttcgacggggcagtggggtctggggacagngttcactctcaccatcagcagcctgcagtctgaagtntttgctagtttattactgtcagcactataataacgtcgggaccccgggggtacgttcgggaccgaaggggaccgaagggtacggagactacgaaacgaacgtgtacggctagcaccatctgtcttcacttcccg

SEQ ID NO: 375660 - DNA, 574 bp, Homo sapiens
  misc_feature: GZ8MTXP02FLB5W.17.43.D10.1.454.CMB.2.raw
  modified_base (278)..(278): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaactggcaggctccagctccncatctatggtgccttccaccgagggccgcgtggtcgtcccagccagacttcgaggggcaggtggtctgggacagtagttcactctacactatcagcagcctgcagtctagaagtattttcgacttagtttattaacgtgtacagacctattaaataataaccggttcgggggacccccggggggtaagttaccggggaccgtaaacgggggaaccgtaaagggtagggaacgtaagtacgaaaaccgtacgtacggtacgacgtcgaaccgtactactacgtcgtcttacactccg

SEQ ID NO: 375661 - DNA, 529 bp, Homo sapiens
  misc_feature: GZ8MTXP02HNZTN.17.43.D10.1.454.CMB.2.raw
  modified_base (361)..(361): a, c, t, g, unknown or other
  modified_base (517)..(517): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtcgcttccaccgaggggccgctgggtcgtcccaggccagacttcgaggggcaggtgggtctggggacagngttcactctcaccatcagcagcctgcagtctgaatatttgctagtttatactgtcagtcactataataacgtcgggaccccgggggtacgttcgggaccgaaggggaccgaagggtggagtatacgaaaacgacgtgtacggctggctacatcgtntcttacattccc

SEQ ID NO: 375662 - DNA, 681 bp, Homo sapiens
  misc_feature: GZ8MTXP02JVBCJ.17.43.D10.1.454.CMB.2.raw
  modified_base (311)..(311): a, c, t, g, unknown or other
  modified_base (317)..(317): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttagcctggtatcgagcaagaaacctggccaggcctcccgaggcctcctcatctatggtgtcctccaccgngggccncgtgggtcgtcccagccagacttcggacggggctagggtcggggtcgtggggaactaggtcgttcaaccgttcctaccaaccatcagcacgcctgcagttcgtagtagttagttttgacttagttttacttacgtgttacgagtactaacgttaacgttaaacgtaccgggttaccgggggtaccccccggggggtaaggtttacccggggaacccgggtaaaacgggggtacccggaaaagggggttacggggaaacggtaacgttaaacccgggaaaacggtaccggttacggaccgggtaccgttacgggaacctaaaccgtacgttccgtttacggttcctttaaccgaccttttccccg

SEQ ID NO: 375663 - DNA, 645 bp, Homo sapiens
  misc_feature: GZ8MTXP02JYX6G.17.43.D10.1.454.CMB.2.raw
  modified_base (285)..(285): a, c, t, g, unknown or other
  modified_base (295)..(295): a, c, t, g, unknown or other
  modified_base (311)..(311): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagcaacttagcctggtatcagcagaaacctggccaggctcccaggctcctnatctatggtncttccacgacgggccnctgggtctcccagccagattcgaggggcagggtcgggtcgtggggacaggtgtttcaaccgttctaccaaccataccagccaagtccctggacctagttctaggaacgttatttcgacttagtttattacgtgtacgacgctaattaactaaacgttaccggtacccgggggacccccggggggtacgttccggggaaccggtaaacggggaaccgtaaaggggttacgggaaacgtacgtaaccgtaaaaaccggacgttagggtacggtaccgtacgggaacccgtaaacctcgttaccgttcgtttacccgttaccgtaactttcccccgg

SEQ ID NO: 375664 - DNA, 530 bp, Homo sapiens
  misc_feature: GZ8MTXP02H2H37.17.43.D10.1.454.CMB.2.raw
  modified_base (184)..(184): a, c, t, g, unknown or other
  modified_base (300)..(300): a, c, t, g, unknown or other
  modified_base (351)..(351): a, c, t, g, unknown or other
  modified_base (364)..(364): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccaggggaacgagccaccctctcctgcagggccagtcagagtgtgagcagcaattagcctggtatcagcagaaacctggccaggctccaggctcctcatctatggtgcttccacgngggccgctggtctcccagccagattcgaggggcaggtgggtctgggacagngttcactctcacntcagcagctgcagtctagtaatatttgcttagtttatacttgtcagtactaactataataacgtcggggaccccgggggtagttcgggaccgaagggaccgaagggtcggagacgtacgaaacgtacgtgtacgcgtagaacaccgatctagtccttctacttccg

SEQ ID NO: 375665 - DNA, 552 bp, Homo sapiens
  misc_feature: GZ8MTXP02GILY3.17.43.D10.1.454.CMB.2.raw
  modified_base (317)..(317): a, c, t, g, unknown or other
  modified_base (368)..(368): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagcctggtatcagcaagaaacctggaccaggcctcccaggcctcctcatctatggtgccttccaccgaggggcccncgtgggtcgtcccagccagacttcgaggggcaggtgggtctggggacaggngttcactctacacatcagcagccctgcagtctagagtattttgacttagtttattactgtctagctatataataacgtcggggccccgggggtagtccggaccgaagggaccaagggtcggagactacgaaacgtacgtgtacggctacgaacctaccgtatccgtgttcctctactttccccg

SEQ ID NO: 375666 - DNA, 571 bp, Homo sapiens
  misc_feature: GZ8MTXP02J3E21.17.43.D10.1.454.CMB.2.raw
  modified_base (185)..(185): a, c, t, g, unknown or other
  modified_base (289)..(289): a, c, t, g, unknown or other
  modified_base (324)..(324): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggacagccacctctcctgcagggccagtcagagtgtgagcagcaacttgcctggtatcagcagaacctggccaggctcccaggctcctcatctatggtnccttccaccgagggccgctggtcgtcccagccagnttcgaggggcaggtggggtctggggacaggtcgttcactctcaccatcagcagcctgcagtctgatatttgacttagtttattactgtacagtctactaataaacgtaaccgtccgggggtacccccggggggtacgttaccggggacccgaaaggggaacccgaagggtacgggaacgacgtaaccgaaaacgtaacgtcgacgggtcctaggccgtaccgatcgttacgtccttacactttcccg

SEQ ID NO: 375667 - DNA, 678 bp, Homo sapiens
  misc_feature: GZ8MTXP02FZKF8.17.43.D10.1.454.CMB.2.raw
  modified_base (296)..(296): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttgcctggtatcagcaagaaacctggccaggcctcccgaggcctcctcatctatggtcnccttccaccgaggggcccgcgtcgggtctccccgagccagtacttcggaacggggtcaggtgggtcgtaggggacaggtcgttcaactcgtaccaaccatcgagcagccctgctagtcgtagaagttattttcgacttaagtttacttacgtgtactaacggtacctaaacttaaagtaaacgttaaacccggtcccggggggtaccccccggggggttaacgttacccggggacccgggtaaaacgggggtaacccgtaaaagggggttacgggaaaacggtaaacggtaaccgaaaaaccgggtaacggttcgggtaacggccgttacgggaacctaaccgtaacgttccggttcgttacccttacctactttcccccgg

SEQ ID NO: 375668 - DNA, 553 bp, Homo sapiens
  misc_feature: GZ8MTXP02H9N2E.17.43.D10.1.454.CMB.2.raw
  modified_base (185)..(185): a, c, t, g, unknown or other
  modified_base (196)..(196): a, c, t, g, unknown or other
  modified_base (262)..(262): a, c, t, g, unknown or other
  modified_base (283)..(283): a, c, t, g, unknown or other
  modified_base (294)..(294): a, c, t, g, unknown or other
  modified_base (303)..(303): a, c, t, g, unknown or other
  modified_base (309)..(309): a, c, t, g, unknown or other
  modified_base (358)..(358): a, c, t, g, unknown or other
  modified_base (371)..(371): a, c, t, g, unknown or other
  modified_base (375)..(375): a, c, t, g, unknown or other
  modified_base (394)..(394): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacngcccaccctctcctgcagggccagtcagagtgtgagcagcaacttagcctggtatcagcagaaccnggccaggcctccaggctcctnatctatggtcncttccacgngggccngtgggtctcccagccagtagtcgaggggctaggtcggctgggacaggtnttcactctcaccntcancagctgctagctagaattntttgcttagtttatactgtacagtcaatataagtaccggtccgggggccccgggggtatcggaaccggaagggtaccgaaggggtcggaaacgtataaccgaaaacgacgtcggtacgcctaggaaccacacgttctcgttaccttacgtacttccccg

SEQ ID NO: 375669 - DNA, 672 bp, Homo sapiens
  misc_feature: GZ8MTXP02G7EH3.17.43.D10.1.454.CMB.2.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttgcctggtatcagcagaacctggccaggcctcccaggcctcctcatctagtggtcgccttcccgaccgaggggcccgtcgtcgggtcgtccccgagcccaggtacgttcggacgggggtctagggttcggggtacgtggggactaggtacggttccaacgttcctaccacctatcgagcacgcctgctagtcgtagtaacgttatttttagacttagttttacttacgttacggttacacgtactaacgttaacgttaaacgtaacccggttccgggggtacccccggggggttacgttaccggggaaccggtaaacgggggaccgtaaaggggtacgggaacgtacgtaaacggaaaacggtaacgtacggtacggtacgtacggaaccgtaaccgtacgttccggttcgttacctttacgtactttccccg

SEQ ID NO: 375670 - DNA, 592 bp, Homo sapiens
  misc_feature: GZ8MTXP02JMXZ2.17.43.D10.1.454.CMB.2.raw
  modified_base (206)..(206): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctntcctgcagggccagtcagagtgtgagcagcaacttgcctggtatcagcagaacctggccaggctcccaggcctcctcatctatggtctccttccaccgagggccgcgtcgggtcgtccccagccagacttcgaggggcaggtggtctggggacaggtgttcactctcaccatcagcacgcctgcagtctagtaacgtatttcgcttagtttacttacgtgtacagtactaacttataaacgtaaccggtccggggaccccggggggtacgttccgggaccgaaacggggacccgaaagggtcggaacgtaacgtaaccgaaaacggtaacgtcggtacggacgtacgccgtaccgtacttacgtacgttaccttactactttcccg

SEQ ID NO: 375671 - DNA, 607 bp, Homo sapiens
  misc_feature: GZ8MTXP02ISMUX.17.43.D10.1.454.CMB.2.raw
  modified_base (302)..(302): a, c, t, g, unknown or other
  modified_base (313)..(313): a, c, t, g, unknown or other
  modified_base (319)..(319): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggcctcccagatactactggagaaatggtgatgacgcagtctccagccaccctgtctgtttctccgaggggaacgagccaccctctcctgcagggccagtcagagtgtgagcagcaacttagcctggtatcagcaagaaacctggccaggcctcccgaggcctcctcatctagtggtcnccttccaccgngggccncgttgggtctcccagccagattcgaggggcaggtggtctgggacagtgttcactctacaccatcgagcagcctgcagtcgtagtaagttattttgacttagtttattacgtgttcagtactaacttaataaacgtaaccggtccgggggtacccccggggggtacgttaccgggaccggtaaacggggacccgaaaggggttacggaacgtaacgtaaccgaaaacggtacgttacggtacggactacgaaccgtacgtacgttcgtcgttacctttcgactttcccg

SEQ ID NO: 375672 - DNA, 584 bp, Homo sapiens
  misc_feature: GZ8MTXP02IFMAO.17.43.D10.1.454.CMB.2.raw
  modified_base (259)..(259): a, c, t, g, unknown or other
  modified_base (276)..(276): a, c, t, g, unknown or other
  modified_base (287)..(287): a, c, t, g, unknown or other
  modified_base (303)..(303): a, c, t, g, unknown or other
  modified_base (386)..(386): a, c, t, g, unknown or other
tcagcgtagactagcacgaccggtgctcgatttagactagcagtaaggggggaactgctcagttaggacccagacggaaccatggaagccccagcgcagcttctcttcctcctgctactctggcctcccagatactactggagaaatggtgatgacgcagtctccagccaccctgtctgtttctccgaggggaacagccaccctctcctgcagggccagtcagagtgtgagcagcaacttgcctggtatcagcagaacnggccaggctccagctcncatctatggtncttccaccgagggccncgtggtcgtccccagcccagtactcgaggggcccagggtcggggtctggggactaggtagttccacttctcctacccatcaancacgcctggctagtctgtaagtatttgacttagtttatactgtacagtctaataattaacgtaaccggtccgggggaccccgggggtacgttaccgggaccggtaacgggaccgtaaggggtacggacgaacgtacgaaaacgtacgtacggtcgactcgaccgaacctagtctacgtacttctacgttcctaccccg

SEQ ID NO: 375673 - DNA, 711 bp, Homo sapiens
  misc_feature: GZ8MTXP02I0H8F.17.43.D10.1.454.CMB.2.raw
  modified_base (280)..(280): a, c, t, g, unknown or other
  modified_base (301)..(301): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagcccaccctctcctgcagggccagtcagagtgtgagcagcaacttgcctggtatcagcagaacctggcaggctccaggctcctnatctatggtctcctccaccgnggggcctcgtcgggtcgtcccagccagtacgttcggacgggggtcagggttcggggtctaggggaacctagggtacgtttccaaccgttcctaccaaaccctattaccgaacgcccgtaacggccccttaggaccgtaacggttccgttaaggtaaagtttcgttttttacggactttaaaggtttttaactttaaccggttaggttacctaacggttacctaaacctttaaagttaaaacccggttaaacccggggtccggggggtacccccccgggggggtagttacccggggacccgggtaaaacggggaaccgtaagggtacgggaacgtaaacgtaacgaaaacggtaacgtggtacggacgtagaaccctaacgtattcgtacgttccttacgtactttccccg

SEQ ID NO: 375674 - DNA, 718 bp, Homo sapiens
  misc_feature: GZ8MTXP02ICW2J.17.43.D10.1.454.CMB.2.raw
  modified_base (184)..(184): a, c, t, g, unknown or other
  modified_base (323)..(323): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacagccaccctctcctgcagggccagtcagagtgtgagcagcaacttagcctaggtactcagcaagaaaccctggaccaggcctcccgaggtcctccctacattctagttgggtctccttcccgaaccgnggggcccctcgttggggtcgtaccccagccccgtaagtacttcggagggggtcctaggggttcggggtaccgtgggggaacctagggtacgtttccaacttccgtaccaccgtataccacgacccgtagcccgttagccgtaacgttcgtaaggtaagttaagtttttgacgttagttttacttaacgttgtacgtaagtacctaagtttaactaaaacgttaaccgggtcccgggggtacccccggggggttacgtttacccggggaaccggaaacgggggtaaaccgtaaggggttacgggaacgaaacgttaaccgaaaaacggtaccgttagggtacggttcacggaaccctaccgtattccggttacgtttaccgttctacctttccccg

SEQ ID NO: 375675 - DNA, 651 bp, Homo sapiens
  misc_feature: GZ8MTXP02IGT8W.17.43.D10.1.454.CMB.2.raw
  modified_base (296)..(296): a, c, t, g, unknown or other
  modified_base (312)..(312): a, c, t, g, unknown or other
  modified_base (385)..(385): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagcctggtatcagcagaaacctggaccaggcctcccagctcctcatctatggtcncctccgacgagggccnctgggtctccagccagcttcgacggggctaggtgggtctaggggacaggtcgttcactcctaccaaccatacngcacgccctgctagtctagtaagttacttttgacgttagtttacttacgttcgtactaaggtacctaacgttaaacgtaaacgttaccgggtcccggggggtacccccggggggtaacgtttaccgggaaacccgtaaacgggggaaacccgtaaaggggttcggaaacggtaacgtaaaccgtaaaaacggtacgttcgggtacggtaccgttacggaacctaaccgtaagtttccgtaacgtttccttactaacgtttcccccg

SEQ ID NO: 375676 - DNA, 564 bp, Homo sapiens
  misc_feature: GZ8MTXP02FY3EO.17.43.D10.1.454.CMB.2.raw
  modified_base (280)..(280): a, c, t, g, unknown or other
  modified_base (288)..(288): a, c, t, g, unknown or other
  modified_base (304)..(304): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttagcctggtatcagcagaacctggccaggctcccaggctccnatctatgncttccaccgagggccntggtctcccagccagacttcgaggggcaggtgggtctggggacagtcgttcactctcaccagtcagcagccctgcagtctagaagtatttgactagtttattactgtcagctattataagtaaccgtcggggacccccgggggtacgttaccgggaccgaaacggggacctaaggggtcggaagacgtaacgaaaacggtacgtaggtacggcttaggaaccctaaccgtagttccgtacgttccttacgactttccccg

SEQ ID NO: 375677 - DNA, 616 bp, Homo sapiens
  misc_feature: GZ8MTXP02HF1DC.17.43.D10.1.454.CMB.2.raw
  modified_base (435)..(435): a, c, t, g, unknown or other
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttagcctggtatcagcagaaacctggccaggctcccaggcctcctcatctatggtcgcttcccaccgaggggcccgcttcgggtcgtccccgaggcccaggactttccggagggggcctaggttggggtccgtagggggaccagggtacgtttccaacttcctacacccatcgagcagccctgcagttctagaaagttnttttgacttagtttattacttgtacagtactaactaagttaaacgtaaccggtccggggacccccgggggtacgtaccgggaccggaagggaccgtaaaggggtacggaaggtacgtaacgaaaacggtaacgtggtacgacgtacgaaccgtacgtacttcgtcgttcttctacttcccg

SEQ ID NO: 375678 - DNA, 543 bp, Homo sapiens
  misc_feature: GZ8MTXP02JPK2J.17.43.D10.1.454.CMB.2.raw
  modified_base (276)..(276): a, c, t, g, unknown or other
  modified_base (382)..(382): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttgcctggtatcagcagaactggccaggctccagctctnatctatggtgcttccaccgagggccgctgggtcgtcccagccagtacttcgacggggcaggtggggtctgggacaggtcgttcactctcaccatcagcagcctgcngtctagaagtatttgactagtttattactgtcagtctactataactacgtcggggaccccgggggtacgttcgggaccgtaacgggaccgaagggtcggagtaacgacgaaacgtacgtgtacggctaggcgacctaagtctcggtacttcgactttcccg

SEQ ID NO: 375679 - DNA, 743 bp, Homo sapiens
  misc_feature: GZ8MTXP02IX7PF.17.43.D10.1.454.CMB.2.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggaacagccacctctcctgcagggccagtcagagtgtgagcagcaacttagcctggtatcagcagaaacctggccaggctcccaggctcctcatctatggtcgccttcccaccgaggggcccgcgttcggggtcgtccccaggccccaaggtaactttccggaacggggggtccaaggggttgggggtccgtgggggaacctaagggtacggtttccaaccttccgtaccaacccctaagtcccaaacggccaacggtcccttcggaccgtaaggttacccgtaggtaaacggttatttttcgggaccttaaaggtttttactttaaaccgttggttacctaacggtacctaaacctttaaagtaaaaccgttaaaccgggtccgggggtacccccccggggggggtaacggtttacccggggacccggaaaacgggggtaacccgaaagggggttacgggaaggaacgttaaccgaaaaacggtaaaccgttggtacgggtactacggcctaaccgtacttaccgtacggtttcctttacgtaactttccccg

SEQ ID NO: 375680 - DNA, 544 bp, Homo sapiens
  misc_feature: GZ8MTXP02HWC3F.17.43.D10.1.454.CMB.2.raw
  modified_base (185)..(185): a, c, t, g, unknown or other
  modified_base (281)..(281): a, c, t, g, unknown or other
  modified_base (291)..(291): a, c, t, g, unknown or other
  modified_base (305)..(305): a, c, t, g, unknown or other
  modified_base (352)..(352): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagccaccctctcctgcagggccagtcagagtgtgagcagcaacttagcctggtatcagcagaaacctggccaggctccagctcctnatctatggtncttccacagggccngtggtcgtccagccagattcgaggggcaggtgggtctggggacaggngttcactctcaccatcacgcagcctgcagtctagaagtatttgcttagtttattacgtgttacagtctactaataaactacgtccggggccccgggggtacgttcgggaccgaagggaccgaagggtacggagacgtaacgaaacgaacgtcggtcgacgtgaacctacgactctcgtacttctacttcccg

SEQ ID NO: 375681 - DNA, 527 bp, Homo sapiens
  misc_feature: GZ8MTXP02F6ANM.17.43.D10.1.454.CMB.2.raw
  modified_base (356)..(356): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccacctctcctgcagggccagtcagagtgtgagcagcaacttagcctggtatcagcagaacctggccaggctcccaggctcctcatctatggtgcttccaccgtagggcccgctgggtctcccagccagattcgaggggccaggtggtctggggacagngttcactctcaccatcagcagcctgcagtctagaagtatttgctagtttattactgtcagccattataataaccgtcgggaccccgggggtagttcgggaccgtaagggaccgaaggtacggaagatacgaaacgtactgtacgctgaacacactctgtcttcactttccg

SEQ ID NO: 375682 - DNA, 641 bp, Homo sapiens
  misc_feature: GZ8MTXP02F5NFZ.17.43.D10.1.454.CMB.2.raw
  modified_base (297)..(297): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttgcctggtatcgagcagaaacctggccaggcctcccaggcctcctcatctatggtcnccttccaccgaggggccctcgtcgggtcgtcccgagcctagacttcggaggggctagggtggggtctaggggacaggtcgttccacttctaccaccatcgagcacgccctgacgtagttcgtagtaagttagttttacgacttaagtttacttaacgttgtacctagtactaaacttaataaacgtaaccggtccgggggacccccggggggtaacgttccggggaccgaaacggggtaccgtaaagggtacgggaaggtaactaacggtaaaacggaacgttcggtcggtaccgtagaacccgtaacgtacgttccgttcgtttacctactacgtttaccccg

SEQ ID NO: 375683 - DNA, 611 bp, Homo sapiens
  misc_feature: GZ8MTXP02G2YUG.17.43.D10.1.454.CMB.2.raw
  modified_base (184)..(184): a, c, t, g, unknown or other
  modified_base (318)..(318): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacagccaccctctcctgcagggccagtcagagtgtgagcagcaacttgcctggtatcagcagaaacctggaccaggcctcccgaggcctcctcatctagtgggtcgccttccaccgaggggcccncgtgggtcgtccccagccagtacgttcgacggggctaggtcggggtctaggggactaggtcgttccaacttcctaccaacctatcgagcagccctgcagtctagaacgtatttcgacttagtttattacgttgtacagtactaattataaagtaacggtccgggggacccccggggggtagttccgggaccggaaacggggaccgaaaggggtacggaagtaacgtaacgaaaacggacgttaggacggcgtacggccgtaacctagttcgtcgttacttctaactttccccg

SEQ ID NO: 375684 - DNA, 646 bp, Homo sapiens
  misc_feature: GZ8MTXP02FW8YD.17.43.D10.1.454.CMB.2.raw
  modified_base (283)..(283): a, c, t, g, unknown or other
  modified_base (297)..(297): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccgaggggacagccaccctctcctgcagggccagtcagagtgtgagcagcaacttgctggtatcagcaagaaacctggaccaggcctcccaggcctccncattctatgggtcnccttccgaccgaggggccctcgtgggtcgtcccgagccagtacgttcggagggggcctagggtggggtctagggactaggtgttccacttctaccacctatcagcagcctgactagtctagattatttcgacttagtttatacgttagtacacgtactaacgttaagtaaaccgtaccgggccgggggtacccccgggggtagttaccgggaaccgaaacgggggaccgtaaaggggtacggaaacgtaacggtaacccgtaaaaacgggtacgttagggtacggtaccgtacggaaccgtacccgttaaggttccgttccgtttactttacctaaccgtttacccccg

SEQ ID NO: 375685 - DNA, 582 bp, Homo sapiens
  misc_feature: GZ8MTXP02G42D7.17.43.D10.1.454.CMB.2.raw
  modified_base (289)..(289): a, c, t, g, unknown or other
  modified_base (355)..(355): a, c, t, g, unknown or other
  modified_base (372)..(372): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctctcctgcagggccagtcagagtgtgagcagcaacttgcctggtatcagcagaacctggccaggctcccaggctctcatctatggtnccttccaccgacgggccgcgtgggtcgtcccagccagattcgaggggcagtgggtctggggacagngttcactctcacagtcngcagccctgacagtctagaagttatttgacttagtttacttacgtgttcagtactaataataacgtaacggtccgggggacccccggggggttacgtttacgggacccggaacgggaaccggtaagggtagggacgaacgttaacgaaaacggtaacgttcggtacggcgtacggccgtaaccacgttctacgttcttacactttccccg

SEQ ID NO: 375686 - DNA, 565 bp, Homo sapiens
  misc_feature: GZ8MTXP02GMUGV.17.43.D10.1.454.CMB.2.raw
  modified_base (305)..(305): a, c, t, g, unknown or other
  modified_base (353)..(353): a, c, t, g, unknown or other
  modified_base (389)..(389): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagcctggtatcagcagaacctgcaggctccaggcctcctcatctatgtgcttccaccagggccnctgggtcgtcccagccagattcgaggggcaggtgggtcgtgggacagngttcactctcacatcagctagcctgcagtctgagtntttgctagtttattactgtcagactattaataaactaacgtccggggacccccggggggtacgttaccgggaccgtaaacggggaccgaagggtagggacgagtaaccgaaaacggtaaccgtaggtacgcgtaggaaccgtaccacgttacgtcgtaccttactacgtttccccg

SEQ ID NO: 375687 - DNA, 669 bp, Homo sapiens
  misc_feature: GZ8MTXP02H0KQO.17.43.D10.1.454.CMB.2.raw
  modified_base (184)..(184): a, c, t, g, unknown or other
  modified_base (281)..(281): a, c, t, g, unknown or other
  modified_base (304)..(304): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacacgccaccctctcctgcagggccagtcagagtgtgagcagcaacttagcctggtatcagcagaaacctcggccaacggctcccacncgggggggtcctcatctatggtntcgttccaccgtacggccggctcgggtcgtcccgacgccgagacttcggacggggcgaggtggggtcgtcgggacgagtggtcactcctcaccactcagcagctgctagtcgtagaagttatttcgtcgttagtttattacttaggtctagtacaacgttataaacgtaaccggtaccgggggtaccccggggggtacccgggtttaccggggacccggtaaacggggaaccgggaaccggggttaacgggaagggtaacggttaaaccgaaaaccgggtaaacggtaggttacgggacgttacggaaccggtaacccgtaaacttccgttaacggtttcccgtttacgttaaccgtttcccccg

SEQ ID NO: 375688 - DNA, 575 bp, Homo sapiens
  misc_feature: GZ8MTXP02H2RU1.17.43.D10.1.454.CMB.2.raw
  modified_base (185)..(185): a, c, t, g, unknown or other
  modified_base (292)..(292): a, c, t, g, unknown or other
  modified_base (321)..(321): a, c, t, g, unknown or other
  modified_base (353)..(353): a, c, t, g, unknown or other
  modified_base (355)..(355): a, c, t, g, unknown or other
  modified_base (369)..(369): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagccaccctctcctgcagggccagtcagagtgtgagcagcaacttagcctggtatcagcagaaacctggccaggctcccaggctctcatctatggtnccttccaccgagggccgctgggtctcccngccagattcgaggggcaggtgggtctgggacngngttcactctcaccntcagcagcctgcagtctagaagtatttgctagtttattactgtcagcacttataagtaaaccgtcggggtacccccggggggtagttaccggggaccgaaagggggacccgaaagggggttacgggaaggtaacgtaacgaaaaccggtaaacgttggacgggtctacggccaaccgaattctcggttacctttacactttccccg

SEQ ID NO: 375689 - DNA, 593 bp, Homo sapiens
  misc_feature: GZ8MTXP02IL9L6.17.43.D10.1.454.CMB.2.raw
  modified_base (250)..(250): a, c, t, g, unknown or other
  modified_base (282)..(282): a, c, t, g, unknown or other
  modified_base (304)..(304): a, c, t, g, unknown or other
  modified_base (312)..(312): a, c, t, g, unknown or other
  modified_base (367)..(367): a, c, t, g, unknown or other
  modified_base (375)..(375): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccaggggaacagcccaccctctcctgcagggccagtcagagtgtgagcagcaacttagcctggtancagcaagaactggcaggctccccgagcctccnatctagtggtctcctccgacgngggcccgngttggtccgtcccgcgaccagtcgttacggcgggtcgagggtgggtcgtgggacngtacgtcnctctcacatcacgcacgtctgctagtgtaagagttttgttgtactttagtttacgttgtcgtactcgtacttaccgttaaagtaaacgtccccggggtaccgggggacccgggggttcgtaacgggacggtaaacgggacgtaagggtaggacgtacgaaacgaaacgtcgtaggtcgacctgaacctaacgtcttacgtcttactctaccgttcccc

SEQ ID NO: 375690 - DNA, 796 bp, Homo sapiens
  misc_feature: GZ8MTXP02IAO44.17.43.D10.1.454.CMB.2.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagcccacctctcctgcagggccagtcaggagtgtgagcagactaacgttacgccgtaggtactcgagcaacggaaaccctcggaccaggccctcccgaggtccctccgtctacttcgtagttcgggtctcccgttacccgaaccggtacggggtcccctcggttcggggtccgtaccccgaaggtcccgtaaggtacgttcgggaaccgggggtctaacggggttcggggtacggtaggggaacctagggttacgtttaccaccttcctaaccaaccgttactaccgaacggcctaaccggtcctcggccgtaaacggttccgttaaaggtaaacgttttcgtttttacggaaccgtttttaggttttaactaaccgtttcgtaccgtaaacggttaccttaaaagtttaaaccgtaaacggtttaacccgggggcccccgggggggttacccccgggggtacgtttacccggggaaacggttaaaccgggggaacggtaaaacggggtcgggaaaacgtccgtaaaacggaaaaccccggtgttcgggacggttcaccggaacctaactggtttacgcgtttcctacgtacgttcccccg

SEQ ID NO: 375691 - DNA, 606 bp, Homo sapiens
  misc_feature: GZ8MTXP02F5FDM.17.43.D10.1.454.CMB.2.raw
  modified_base (322)..(322): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagcaacttagcctggtatcagcaagaaacctggccaggcctcccgaggcctcctcatctagtggtcgtccttccaccgaggggtcccncgttgggtcgtcccagccagtacttcggaggggctagggtgggtcgtggggaactaggtcgttcacttctaccgacctatcagcacgcctgcagtctagaagttatttgacttagtttacttacgtgtactagtactaactaataacgtaaccggtccggggaccccgggggtacgtcggaccgtaaagggaccgtaagggtacggagactacgaaaacggtacgtacggacggtcgtacggaacctaccgtaacgtcgtcgttaccttcctaacgtttccccg

SEQ ID NO: 375692 - DNA, 623 bp, Homo sapiens
  misc_feature: GZ8MTXP02IRSZ9.17.43.D10.1.454.CMB.2.raw
  modified_base (250)..(250): a, c, t, g, unknown or other
  modified_base (315)..(315): a, c, t, g, unknown or other
  modified_base (367)..(367): a, c, t, g, unknown or other
  modified_base (377)..(377): a, c, t, g, unknown or other
  modified_base (386)..(386): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttgcctggtancagcagaacctggccaggctcccaggctcctcatctatggtcgccttcccgaccgacggggcccncgtgggtcgtccccagccagagttccgaggggcaggtgggtctggggacagngttcacttcncaccatcancacgcctgcagtctagtaacgtattttgacttagttttaacttactgtacaagtactaacttaataaagtaaccggtccgggggacccccggggggtacgttaccgggaccggtaaacggggaaccgtaaaggggtacgggaacggtaacgtaaccggaaaaacggtaacgtagggtaccggacgttaggaacccacccgtaattccggtacgttccctttacgtacgtttcccccg

SEQ ID NO: 375693 - DNA, 633 bp, Homo sapiens
  misc_feature: GZ8MTXP02IO7PV.17.43.D10.1.454.CMB.2.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtcctgtttctccaggggacgagccaccctctcctgcagggccagtcaggagtgtgagcagctaacttagcctggtatcagcaagaactggccaggcctcccgaggcctcctcatctagtggtcgcttcccaccgagggcctcgtgggtctcccagccagcttcgaggggcaggtggtcgtggggaacagtcggtttcacgtcctaccacctagtcacgcagcctggctagttctagtaacgttattttcgacttagtttacttactgttacacgtctaacttagtaaaacgtaccggtccgggggtaccccgggggtacgttaccgggaccgtaaagggggacccgtaaaggggttagggaaacggtacgttaaaccgaaaaacggtaacggttcggtacggtcgttacggaactacccgtaacttccgttacgttacctttccgtaacgtttccccg

SEQ ID NO: 375694 - DNA, 566 bp, Homo sapiens
  misc_feature: GZ8MTXP02JT8Q7.17.43.D10.1.454.CMB.2.raw
  modified_base (293)..(293): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccgaggctcctcatctatggtnccttccaccgaggggccgctgggtcgtcccagccagtacttcgacgggggcagggtggggtctggggaccaggtcgttcactctcaccatccagcacgcctgcacgtctagaagtattttgacttagttttattactgtacagtactataataaacgtaaccggtcgggggacccccggggggtacgttccggggaccgaaacggggaccgaaagggtcggagagtacgaaaacggacgtcgcgactgaacgacatctagtcttcacttcccg

SEQ ID NO: 375695 - DNA, 631 bp, Homo sapiens
  misc_feature: GZ8MTXP02H30O3.17.43.D10.1.454.CMB.2.raw
  modified_base (184)..(184): a, c, t, g, unknown or other
  modified_base (228)..(228): a, c, t, g, unknown or other
  modified_base (284)..(284): a, c, t, g, unknown or other
  modified_base (298)..(298): a, c, t, g, unknown or other
  modified_base (436)..(436): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacagccaccctctcctgcagggccagtcagagtgngagcagcaacttgcctggtatcagcagaacctggccaggcctcccgaggcctcctnatctagtcgggtcnccttcccgaaccgcggggccgtcgtgggtccgtcccgagccctaaggtacgttcggacgggggctaggggttcgggtcgtggggacaggtcgttcactctacaccagtcacgcacgcctgccgtagtcgtagtaagtnttttgactttagtttacttacgtgttacacgtactaagttaactaaacggtaccgggttacccgggggacccccggggggttaagtcccggggaaccggtaaacggggaaccgtaaaggggtcggaaacgtacgaaacgtaaacggacgtgtacggactacggaaccacctagtcgtcgtccttcgtacttcccg

SEQ ID NO: 375696 - DNA, 608 bp, Homo sapiens
  misc_feature: GZ8MTXP02FWH29.17.43.D10.1.454.CMB.2.raw
  modified_base (195)..(195): a, c, t, g, unknown or other
  modified_base (283)..(283): a, c, t, g, unknown or other
  modified_base (293)..(293): a, c, t, g, unknown or other
  modified_base (394)..(394): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccaggggaacngccaccctctcctgcagggccagtcagagtgtgagcagcaacttagcctggtatcagcagaacctggccaggcctcccaggcctcctnatctatggtntccttccacgagggccgctgggtctcccagccagtactcgacggggcaggtggtctggggacaggtcgttcactctccacctatcagcacgcctgactgtntacgtaagtagttttgacttagtttacttaacgttgtactagacctaagttaactaaacgttaaccggtccgggggtacccccggggggtacgtttacccggggaccgtaaacggggaaccgaagggtacggaaggtaacgtaacgaaaacggtaacgtcgtacggaccgtagaacccgtaccacttacgtacggttcttacgtactttccccg

SEQ ID NO: 375697 - DNA, 621 bp, Homo sapiens
  misc_feature: GZ8MTXP02GWUE5.17.43.D10.1.454.CMB.2.raw
  modified_base (292)..(292): a, c, t, g, unknown or other
  modified_base (303)..(303): a, c, t, g, unknown or other
  modified_base (320)..(320): a, c, t, g, unknown or other
  modified_base (378)..(378): a, c, t, g, unknown or other
  modified_base (402)..(402): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagccttggtatcagcaagaaaccctggaccagggcctcccgaggcctcctnatctatggtcncttcccacgagggccgntgggtctcccagccagattcggaggggcaggtggctgggacagcgttcactcacacancagcagctgctagtctagaagttntttgacttagtttatacgtgtcagtactacttaataacgtaaccggtccgggggacccccggggggtacgtttaccgggaccggtaaacggggaccggtaaagggtacgggtaaacgtacggtaaaccggaaaacggtaccggttaggggttaccggccggtacggaacccgtaacctaacgttccgttacggtttacctttccgtaacgtttcccccg

SEQ ID NO: 375698 - DNA, 552 bp, Homo sapiens
  misc_feature: GZ8MTXP02F1LD4.17.43.D10.1.454.CMB.2.raw
  modified_base (293)..(293): a, c, t, g, unknown or other
  modified_base (354)..(354): a, c, t, g, unknown or other
  modified_base (381)..(381): a, c, t, g, unknown or other
  modified_base (391)..(391): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctctaggggaacagccaccctctcctgcagggccagtcagagtgtgagcagcaacttagcctggtatcagcagaacctggccaggctcccaggcctcctcatctatggtncttccaccgagggccgctggtcgtcccagccagattcgaggggcagtgggtctgggacagngttcactctccacatcagcagcctgcngtctgaagtntttgctagtttattattgtcagtactacttaattaaactaaccggtccggggtacccccggggggtaacgttccgggaccgtaacgggtaccgaagggtcggagacgtacgaaaacgacgtggtacggcgtacgcgaactactcgtgtcttcactttcccg

SEQ ID NO: 375699 - DNA, 604 bp, Homo sapiens
  misc_feature: GZ8MTXP02GCFXL.17.43.D10.1.454.CMB.2.raw
  modified_base (211)..(211): a, c, t, g, unknown or other
  modified_base (287)..(287): a, c, t, g, unknown or other
  modified_base (293)..(293): a, c, t, g, unknown or other
  modified_base (297)..(297): a, c, t, g, unknown or other
  modified_base (312)..(312): a, c, t, g, unknown or other
  modified_base (318)..(318): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctccngcagggccagtcagagtgtgagcagcaacttagcctggtatcagcaagaaacctggccaggcctcccagcctcctnatctanggtncttccacgagggccntggtcncccagccagatcgaggggcaggtgggtctgggacagtgtcactctccacatcagcagcctgcagtcgtagaagtattttgcttagtttattacgtgtacagtactaattaagtaaacgttaaccggtccgggggtacccccggggggtacgttaccggggaacccggaaacgggggtaaccgaaagggtacgggaacggtaataaaccggtaaaaacggtaacgttagggtacggacgtacggaaccgaaccctagttcgttacgttccttaccgtactttccccg

SEQ ID NO: 375700 - DNA, 601 bp, Homo sapiens
  misc_feature: GZ8MTXP02GKR49.17.43.D10.1.454.CMB.2.raw
  modified_base (184)..(184): a, c, t, g, unknown or other
  modified_base (196)..(196): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttcnccgaggggaacngccacctctcctgcagggccagtcagagtgtgagcagcaacttgcctggtatcagcaagaacctggccaggcctcccgaggcctcctcatctagtggtcgccttccgaccgaggggcccgcgtgggtcgtccccagccagacgttcgacggggcaggtgggtctggggacaggtacgttcactcgtcacctatcagcagccctgacgtagtcgtagaaacggttattttgacttagtttattacgtgtacagtactaactaataaacgtacgtccggggaccccgggggtacgttcgggaccgtaaggggtaccgaaggtacggaacgtacgtaacgaaaacgtacgtcggtacgcgtacggaacctaaccgtactacgttcgtacctttacgtacgtttacccg

SEQ ID NO: 375701 - DNA, 586 bp, Homo sapiens
  misc_feature: GZ8MTXP02HZ98Y.17.43.D10.1.454.CMB.2.raw
  modified_base (184)..(184): a, c, t, g, unknown or other
  modified_base (301)..(301): a, c, t, g, unknown or other
  modified_base (313)..(313): a, c, t, g, unknown or other
  modified_base (336)..(336): a, c, t, g, unknown or other
  modified_base (361)..(361): a, c, t, g, unknown or other
  modified_base (363)..(363): a, c, t, g, unknown or other
  modified_base (370)..(370): a, c, t, g, unknown or other
  modified_base (402)..(402): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncgagggacagccacctctcctgcagggccagtcagagtgtgagcagctaacttagccgttaggatcagacaacgaaacctggaccaggcctcccaggcctcctacatctatgggtcnccttaccaccgngggccgcgtggtctccagccagngttcgaggggcaggtggctgggacngntcactcncacatcagcagcctgacacgtatacgtaagtnttttagacgttatttacttaacgtgttacagactaagtaagtaacgtaccgggtcggggaccccgggggtatccgggacggaaacgggaccgaagggtacggagtaacgtaacgaaaccggtacgtacgggtacgacgtacgaaccgtacgtaacgtccggtacttacgttactactttccccg

SEQ ID NO: 375702 - DNA, 602 bp, Homo sapiens
  misc_feature: GZ8MTXP02ILHKT.17.43.D10.1.454.CMB.2.raw
  modified_base (185)..(185): a, c, t, g, unknown or other
  modified_base (283)..(283): a, c, t, g, unknown or other
  modified_base (294)..(294): a, c, t, g, unknown or other
  modified_base (310)..(310): a, c, t, g, unknown or other
  modified_base (383)..(383): a, c, t, g, unknown or other
  modified_base (386)..(386): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagccaccctctctgcagggccagtcagagtgtgagcagcaattgcctggtatcagcagaaacctggacccagcctcccaggcctccncatctatggtnccttccacgcgggccncgtcggtcgtacccagccagacttcggacggggctaggtcgggtctaggggacagtcgtcactctccacctancancacgctcgcgtagtctagtattgtttacgtattagtttacttagtctactagtactaacttaacgtaacgtaccggggtcccgggggtacccgggggtacgtacccgggaacggaaccgggaacgtaacggggtacggaacggtacgtaaacgaaacggtacggtacggacgtacgtacgaaccgtacgtacgttcgtacgtcctacgttcctccg

SEQ ID NO: 375703 - DNA, 678 bp, Homo sapiens
  misc_feature: GZ8MTXP02F663K.17.43.D10.1.454.CMB.2.raw
  modified_base (300)..(300): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttgcctggtatcagcaagaaacctggaccaggcctcccgaggcctcctcatctagtggtcnccttccgaccgaggggccctcgtcgggtccgtcccgagccagtacttccggaggggcctagggtcggggtcgtaggggaccaggtacgttccacgtcctaccacctatcagcagcctgctagtctagagttagtttgacttaagtttattacgtgtacagtactaacttaaagttaaacgtaacccgggtcccgggggtacccccgggggtaacgttacccgggaacccgggtaaaacggggaacccggtaaagggggtacggaaaacggtaaaccggttaacgaaaaaccgggttaccgtcgggtaacggtcccgtaacgaacccgttaaacccgtaatttcccggttctttaccgtttaccgtaactttcccccgg

SEQ ID NO: 375704 - DNA, 613 bp, Homo sapiens
  misc_feature: GZ8MTXP02F14RB.17.43.D10.1.454.CMB.2.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttgcctggtatcagcagaaacctggaccaggctcccaggcctcctcatctatggtgccttcccgaccgaggggcccgcgttgggtcgtccccagcccaagtacttcggacgggggtctagggtggggtcgtgggggaaccagggtacggtttccaacttcctaccaaccctatccgaagcagccctgcctagttctagaagttattttgacttaagtttattactgtacagtactaacgtaattaaacgtaccggtccgggggtacccccgggggtacgttaccgggaccgtaaacggggaccgaagggtagaacgaagtacgaaaacgtacgtggtacggctacgccaccgtatcgtgtccttacactttcccg

SEQ ID NO: 375705 - DNA, 542 bp, Homo sapiens
  misc_feature: GZ8MTXP02JQLN3.17.43.D10.1.454.CMB.2.raw
  modified_base (360)..(360): a, c, t, g, unknown or other
  modified_base (389)..(389): a, c, t, g, unknown or other
  modified_base (483)..(483): a, c, t, g, unknown or other
  modified_base (508)..(508): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcaagaaacctggccaggctcccaggctcctcatctatggtgccttccaccgagggccgcgtggtcgtcccagccagattcgaggggcaggtgggtctggggacaggngttcactctcacatcagcagcctgcagtnagagatttgctagtttattactgtacagcatataaatacgtggggacccccgggggtagttccggaccgaaggggaccaaagggtggaacgtanaaccgaaaacggactagtcggaccngaaccaccgtattctacgttcctactacttcccg

SEQ ID NO: 375706 - DNA, 711 bp, Homo sapiens
  misc_feature: GZ8MTXP02INR81.17.43.D10.1.454.CMB.2.raw
  modified_base (288)..(288): a, c, t, g, unknown or other
  modified_base (311)..(311): a, c, t, g, unknown or other
  modified_base (318)..(318): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccacctctcctgcagggccagtcagagtgtgagcagctaacttagcctggtatcagcaagaaacctggccaggcctcccgaggcctcctnatctagtggtcgccttccaccgngggtccngttggcgtcccagcctaggacttcggacggggctagggtcggggtcgtggggaacctaggtcggtttccaacgttcctaccgaaccctagtccgacgccacgcccgtgaccgtacgtccgttaggtaagttagttttcgtaccgtttagttttaactttcgttacgttaccgtacgtacctaaacgttaaacgtttaaacgtaaacccgggttcccgggggtaccccccgggggggtaacgtttacccggggaaccgggtaaaccgggggtaccggtaaaacgggggttcggaaaacgggtaacgtaaaccggtaaaaccggtaacggttacggtacggtactacggaacctaacgtacgttccgttacgttcctttaccgtacgtttccccg

SEQ ID NO: 375707 - DNA, 658 bp, Homo sapiens
  misc_feature: GZ8MTXP02HYIAG.17.43.D10.1.454.CMB.2.raw
  modified_base (259)..(259): a, c, t, g, unknown or other
  modified_base (290)..(290): a, c, t, g, unknown or other
tcagcgtagactagcacgaccggtgctcgatttagactagcagtaagggggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcaggagtgtgagcagcaacttgcctggtatcagcaagaacnggccaggctcccaggcctctcatctatggtntccttccaccgaggggcccgcgttcgggtctccccgagcccagtacgttcggaggggccctagggtggggtctaggggactaggtacgtttccgacttcctaccaaccctagttcaacgccacgtccctgcgagtcgtagtaagttagtttttggacttagttttacttaacgttgttacctagtactaattaacttaaacgtaacccggtccgggggtacccccggggggtacgttacccggggaaccggtaaacggggacccgtaaagggtacgggaaggtaacgtaacggaaaaccgtaacggttaggtacgtcctacggacgtaaccgtattaccgttcgttcttaccgtacctttccctcccg

SEQ ID NO: 375708 - DNA, 608 bp, Homo sapiens
  misc_feature: GZ8MTXP02JJSE3.17.43.D10.1.454.CMB.2.raw
  modified_base (207)..(207): a, c, t, g, unknown or other
  modified_base (283)..(283): a, c, t, g, unknown or other
  modified_base (287)..(287): a, c, t, g, unknown or other
  modified_base (295)..(295): a, c, t, g, unknown or other
  modified_base (305)..(305): a, c, t, g, unknown or other
  modified_base (311)..(311): a, c, t, g, unknown or other
  modified_base (358)..(358): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccacctctccngcagggccagtcaggagtgtgagcagcaacttgcctggtatcagcaagaacctggccaggcctacccagcctcctnactntatggtcncttccaccgngggccncgtgggtctccagccagtattcgaggggcaggtggtctagggacagngttcactctaccacatcagcacgcctgcagtctagaagtattttgacttagtttattacgtgtacacgtctaacttaattaaacgtaaccggtacgggggacccccgggggggtaacgttaccggggaccgaaacgggggaaccgtaaaggggtacgggaaggtaacgtaaacgaaaacggtaaccgttacggacggacctaggaacctaaccgtacgttcgttacggttcctttaccgtactttccccg

SEQ ID NO: 375709 - DNA, 608 bp, Homo sapiens
  misc_feature: GZ8MTXP02HNUZT.17.43.D10.1.454.CMB.2.raw
  modified_base (285)..(285): a, c, t, g, unknown or other
  modified_base (297)..(297): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagccaccctctcctgcagggccagtcagagtgtgagcagcaacttgcctggtatcagcaagaaacctggccaggcctcccaggcctcctnatctatgggtcnccttccaccgaggggcccgtctgggtcgtcccagccctaggacttcggacgggggtccaggggttcggggtcgtggggacaggtacgtttcaactctaccaacctagtcagcacgcctgcagtctagtaagtatttgacttagtttacttacttgtacagtctaactataaacgtacggtccggggtacccccggggggtagttaccgggaccgaaacggggaccgaaagggtacggaagacgtaaacgaaaacggtaacgtggtacggcgtacggaactaccaacgttcgtcgttcttctaacttccccg

SEQ ID NO: 375710 - DNA, 520 bp, Homo sapiens
  misc_feature: GZ8MTXP02GQ0PH.17.43.D10.1.454.CMB.2.raw
  modified_base (291)..(291): a, c, t, g, unknown or other
  modified_base (306)..(306): a, c, t, g, unknown or other
  modified_base (311)..(311): a, c, t, g, unknown or other
  modified_base (351)..(351): a, c, t, g, unknown or other
  modified_base (511)..(511): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctctcctgcagggccagtcagagtgtgagcagcaacttagcctggtatcagcagaaacctggccaggctcccaggctctcatctatggtncttccaccagggccnctggntcccagccagattcgaggggcagtggggtctggggacagngttcactctcaccatcagcagccctgcagtctgaagtattttgctagtttatactgtcagcactataataacgtcgggcccccgggggaagttccgggaccgaaaggggacccgaaaagggtcggagactacgaaaacgactagtcgctgcaccagtctntctctactc

SEQ ID NO: 375711 - DNA, 679 bp, Homo sapiens
  misc_feature: GZ8MTXP02JFY22.17.43.D10.1.454.CMB.2.raw
  modified_base (197)..(197): a, c, t, g, unknown or other
  modified_base (227)..(227): a, c, t, g, unknown or other
  modified_base (325)..(325): a, c, t, g, unknown or other
  modified_base (429)..(429): a, c, t, g, unknown or other
  modified_base (669)..(669): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacncgccaccctctcctgcgagggccagtcagngtgtgagcagctaattgcctggtatcgagcaagaaacctggaccaggcctacccgaggcctccgtacatctatggtcgccttccaccgcggggtcccncgtacgggtccgtaccccagcccgtaagtcgttaccggaggggtcctaaggggttcggggtcgtaggggacctaaggtgtttccaacgttcctaccgacttacnccgagtacacgtccctagccgtacgtacgtaggtaaacgttgttttcgtaacttaagttttacgtaacgttcgtaaactacggtacctaaattaaacgttaaacgtaccggggtcccgggggtaacccccggggggtacgttccgggaaccggtaaacgggggaaccgtaagggttacggaacgtagtaaaccgaaaacggtcctggtaccggctacggaacacctgtcgtcgtcttacncgtttccccg

SEQ ID NO: 375712 - DNA, 611 bp, Homo sapiens
  misc_feature: GZ8MTXP02JGSE0.17.43.D10.1.454.CMB.2.raw
  modified_base (280)..(280): a, c, t, g, unknown or other
  modified_base (292)..(292): a, c, t, g, unknown or other
  modified_base (429)..(429): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagcccacctctcctgcagggccagtcagagtgtgagcagcaacttgcctggtatcagcaagaacctggccagctccaggctcctnatctagtggtcncccttccgaccgacggggccgtcgttcgggtcgtccccgagtcccaggtacgttccgaagggggtcctaggggtggtccgtggggaacctagggtcgttccactccgtacaccatcagcagcctgcagtctagagtntttgactagtttattactgtacagtacctattaagtaaacgtaaccggtccgggggacccccggggggtacttacgggaccggtaaacggggacgtaaggggtacggaaggtactaaacggaaacgtaacggttggacgggtctacgaaccgactacgtcgtgtacctttacacgtttcccg

SEQ ID NO: 375713 - DNA, 619 bp, Homo sapiens
  misc_feature: GZ8MTXP02FV1C4.17.43.D10.1.454.CMB.2.raw
  modified_base (247)..(247): a, c, t, g, unknown or other
  modified_base (257)..(257): a, c, t, g, unknown or other
  modified_base (270)..(270): a, c, t, g, unknown or other
  modified_base (283)..(283): a, c, t, g, unknown or other
  modified_base (395)..(395): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgttctccaggggacagccacctctcctgcagggccagtcagggtgtgagcagcaacttagcctggtatnagcagaaccngcagctccgagcnctcatctatggcncttcccacgtacggccgctggtctcccgagccagatcgagggccaggtcggtcgtagggacagacgtttcgactctcaccagtcagcagcctcgacgatcgtagtaaagttntttcgtattagttacttactacgtacagtactaactaacgttaacggtaaccgggtcccgggggtacccgggggaacgttaccgggaaacggaaccgggtaaacggtaacgggtacgggaaacgtaaccgtaaacggaaaacggttacggtacggtacggaccgtaacgaacctaaccgttacgtaccggttcgttaccgttcgttaaccgtttcccgtacccg

SEQ ID NO: 375714 - DNA, 749 bp, Homo sapiens
  misc_feature: GZ8MTXP02H7C36.17.43.D10.1.454.CMB.2.raw
  modified_base (184)..(184): a, c, t, g, unknown or other
  modified_base (196)..(196): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggaacngcccaccctctcctgcagggccagtcagagtgtgagcagcaacttgcctggtatcagcagaacctggaccaggcctcccgaggcctcctcactctagtcggtcgccttcccgaccgcggggcctcgtcgggtccgtcccgagcccaaggtacgttcggaaccgggggtctaggggttcggggtccggtaggggaccgtaggtccgtttccaaccttccgtacccaacctacgtccaacgccacggccctacggaccgtaggtaccgttaggtaaagtttcgtttttacggaccttttaaggtttttaacttaacgtttcggtaacctaggttaaccttaacgttaaacgtttaaaacggttaccccgggggttacccggggggtacccccccgggggggttaacggtttcccgggggtaaaacccggtaaacgggggaacccgtaaaagggggttacggaaaacggttacgaaaacccggtaaaacggtaccgttagggtccggacgtacggaaccctacgtgttaccgttacgttccttacgttactccccg

SEQ ID NO: 375715 - DNA, 555 bp, Homo sapiens
  misc_feature: GZ8MTXP02FHOZ7.17.43.D10.1.454.CMB.2.raw
  modified_base (248)..(248): a, c, t, g, unknown or other
  modified_base (281)..(281): a, c, t, g, unknown or other
  modified_base (291)..(291): a, c, t, g, unknown or other
  modified_base (300)..(300): a, c, t, g, unknown or other
  modified_base (306)..(306): a, c, t, g, unknown or other
  modified_base (390)..(390): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccaggggaacagccaccctctcctgcagggccagtcagagtgtgagcagcaacttgcctggtancagcagaacctggccagggctcccaggctcctnatctatgtcncttccacgngggccnctgggtctcccagccagcttcgaggggcaggtgggtctggggacagtcgtcactctcacatcagcagcctgcagtctagaagtntttgctagtttattactgtacagctactaataaataccggtcgggggacccccggggggtagttccggggaccgaaacggggtaccgaaaggggtcggaagataccgaaaacgacgtggtacggctacggaaccaccgtacgtctacgttctactactttccccg

SEQ ID NO: 375716 - DNA, 638 bp, Homo sapiens
  misc_feature: GZ8MTXP02F8AQU.17.43.D10.1.454.CMB.2.raw
  modified_base (184)..(184): a, c, t, g, unknown or other
  modified_base (282)..(282): a, c, t, g, unknown or other
  modified_base (289)..(289): a, c, t, g, unknown or other
  modified_base (293)..(293): a, c, t, g, unknown or other
  modified_base (301)..(301): a, c, t, g, unknown or other
  modified_base (306)..(306): a, c, t, g, unknown or other
  modified_base (352)..(352): a, c, t, g, unknown or other
  modified_base (362)..(362): a, c, t, g, unknown or other
  modified_base (369)..(369): a, c, t, g, unknown or other
  modified_base (382)..(382): a, c, t, g, unknown or other
  modified_base (415)..(415): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggacagccacctctcctgcagggccagtcagagtgtgagcagctaacttagcctggtatcagcagaaacctggaccaggctcccaggcctcncatctanggtnctccacgnggccnctcgggtcgtccagccagactcgacggggcagtgggtctggacagngttcacttcncaacctncagccagcctgcngtctagaagttatttgacttagttatttacgtntacgtacgcaacgtttaataacgtaaaccggttccgggggtacccccggggggttacgtttaacccggggaccgaaaacgggggtacccgtaaaaggggttacggggtaaagaacgtaaccggtaaaaacggtaaaccggttaggacgggtccgttacgggaaccccgtaaccgtaaatttacccggttaccgtttccgtttaccgtaacgtttttacccccg

SEQ ID NO: 375717 - DNA, 732 bp, Homo sapiens
  misc_feature: GZ8MTXP02HTAFH.17.43.D10.1.454.CMB.2.raw
  modified_base (185)..(185): a, c, t, g, unknown or other
  modified_base (197)..(197): a, c, t, g, unknown or other
  modified_base (225)..(225): a, c, t, g, unknown or other
  modified_base (251)..(251): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacngccaccctctcctgcagggccagtcagngtgtgagcagcaattagcctggtacnagcaagaacctggccaggcctcccgaggcctcctcatcgtatcgggtcgccttccgaccgacgggccgtcgttcgggtcgtcccagccagtacgttcggacggggtcagggtcggggtctggggaccaggtcgtttcaaccttctaccaactacgtaccaaggcctacgcccgttgaccgtacggttccttaaggtaaagtttcgttttttacgaccgtttaaggttttttaacttaccgtttagttacgaacggtttaccgtaaacttaaacgttaaaaccgttaaccggggtacccggggggtacccccggggggttaacgttacccggggaaccggtaaacgggggaacccggtaaagggggtacgggaaacggtaaacgtaaaccggtaaaaaccggtaacgttcgggtacgggtacccgacgggtaaccctacccgtaacgttcgttaaccgtcctttacccgtactttcccccgg

SEQ ID NO: 375718 - DNA, 594 bp, Homo sapiens
  misc_feature: GZ8MTXP02HWRQS.17.43.D10.1.454.CMB.2.raw
  modified_base (210)..(210): a, c, t, g, unknown or other
  modified_base (230)..(230): a, c, t, g, unknown or other
  modified_base (344)..(344): a, c, t, g, unknown or other
  modified_base (426)..(426): a, c, t, g, unknown or other
  modified_base (430)..(430): a, c, t, g, unknown or other
  modified_base (443)..(443): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggcctcccagatactactggagaaatggtgatgacgcagtctccagccacctgtcctgtttctccgaggggacagcccacctctccngcagggccaggtcagagtgngagcagcaaattgccttggtatcagcagaacctggccaggctcccgaggcctcctcatctagtgggtctccttaccgaccgtagggccgtcttagggtcgtccccagcctaagngttccgaggggtctaggtcggggtctggggacctagggtcgttcacctcctcacctagcagcagctgcagtctagtaagttnttgnttagttactagtntactacgtactacttaataacgtaccggtcccggggtacccgggggtacgtccgggaacggaacgggtacgaagggtacggacgaacgtaacgaaacgtacgtcggtacgctacgaacgtactacgttctacgtttccttactacctcccg

SEQ ID NO: 375719 - DNA, 739 bp, Homo sapiens
  misc_feature: GZ8MTXP02JKZRO.17.43.D10.1.454.CMB.2.raw
  modified_base (182)..(182): a, c, t, g, unknown or other
  modified_base (194)..(194): a, c, t, g, unknown or other
tcagcgtagactagcacgaccggtgctcgatttagactagcagtaaggggggaactgctcagttaggacccagacggaaccatggaagccccagcgcagcttctcttcctcctgctactctggctcccagatactactggagaaatggtgatgacgcagtctccagccacctgtctgtttcnccgaggggaacngcccaccctctcctgcagggccagtcagagtgtgagcagcaacttagcctggtatcagacagaaacctggaccaggcctcccgaggcctcctcatcctagtggtcgtccttacccgaccgtacggggccctcggttcggggtcgtacccccaggtccccgaaggtaccgttcggaggggtcccctaggggttcggggtcagggggtacagggttacgtttccaccgttaccctacgaaccccgtatacccgaaggccctaaccgggtccttacggacgtacgtaccgtaggtaaagttcgttttaggaccgttttaagtttacgttacttgtaccgtaagtaccttaaacgttaacgttaaaccggtaaccgggttacccggggggtaccccccggggggttagttacccgggggaacccggtaaagggggtaacccggtaaggggtacggggaaacgtaacgtaaacggaaaacccgggtagtacgggttacgaccgtacgaccgaacgtacttcggtacttacctcgtaccgttccctacccg

SEQ ID NO: 375720 - DNA, 646 bp, Homo sapiens
  misc_feature: GZ8MTXP02I3BNH.17.43.D10.1.454.CMB.2.raw
  modified_base (184)..(184): a, c, t, g, unknown or other
  modified_base (227)..(227): a, c, t, g, unknown or other
  modified_base (455)..(455): a, c, t, g, unknown or other
  modified_base (465)..(465): a, c, t, g, unknown or other
  modified_base (490)..(490): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgagggacacgccacctctcctgcgagggccagtcagagtgngagcagcaacttagccgttggtactcgagcaagaaaccctgggaccacgggcctacccgaggtcctcctacacttcgtagtcgggtctccttacccgaaccggaggggcccgtcgtcgggtccgtacccacggtcctagtacgttcggacgggggctaggggtggggtcctaggggaccaaggtccgttaccgaccgtcctacacctagtcacgcacgcctgacagtntagtacgttntttcgacttagttattacgtgttancgataacttagtaaacgtccggtccgggggtaccccgggggtagttaccgggaaccgaacggggtaaccgtaaggggtagacgaacgtaaccgaaaaccgtggtcggtacggcgtacgaaccgtaactcgtacgtcgttactacgtacgtttcccg

SEQ ID NO: 375721 - DNA, 683 bp, Homo sapiens
  misc_feature: GZ8MTXP02I432N.17.43.D10.1.454.CMB.2.raw
  modified_base (185)..(185): a, c, t, g, unknown or other
  modified_base (195)..(195): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcncgagggaacngccaccctctcctgcgagggccagtcagagtgtgagcagcaattagcctaggtatcagcaagaaacctggccaggcctcccgaggcctcctacattcctagtcggtcgtccttcccgaccgaggggcccgtcggttcgggtccgtacccgacggaccgtaggtacgttcggacggggaccgtaggggttcggggtccggtaggggacctagggtccgttaccaccttcctacccacctataccgacgccgacgtcctagacctaggtacgtagtaacgtttattttcgtacgtttacgtttacgtttacgttcgttacgtacgttactaacgtaacgtttaaacgaacccggggtaccgggggtacccccgggggtacgttaaccgggaaccggtaacgggacggtaacgggtacggagtaaacgtacgaaaacggtacgtgtacgcgtacgaaccgactaacgtcttacgtccttactacgtttccc

SEQ ID NO: 375722 - DNA, 899 bp, Homo sapiens
  misc_feature: GZ8MTXP02JWODI.17.43.D10.1.454.CMB.2.raw
  modified_base (286)..(286): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttgcctggtatcagcagaaacctggaccaggcctcccaggcctcctnatctagtggtcgccttcccgaccgaggggtccccgcgttcggggtccgtccccgaggcccgaaggtacgtttcggaacgggggtccctaaggggtcggggtcccgttagggggaaccctagggtaccggtttaccaacccgtttcccgtacccgaacccgtattacccgaaacgggtcccgaaccggtcccccgttggggacccttaaacggtttcccggtttaagggtaaaaaccggggtttttttacgtttttaaccgggtaaccggtttttaaacggttttttaaacgtttaaaccggttcggtttaaaccgttaaccggttaacccttaaaacgttttaaaaccggtttaaaaccgggttaaacccccgggggttacccccgggggggggttaacccccccggggggttaacgggtttacccccgggggaaaacccggggtaaaaccgggggtaaacccgggttaaaagggggttaaccgggtaaaacggtaaaccggtaaaacccggtaaaaaccgggttacggttacggggtaccggtaccgtaccggtaacccgtaacgttacgttcccgtttacggttaccctttaaccgttacccgtttccccg

SEQ ID NO: 375723 - DNA, 530 bp, Homo sapiens
  misc_feature: GZ8MTXP02IFETU.17.43.D10.1.454.CMB.2.raw
  modified_base (289)..(289): a, c, t, g, unknown or other
  modified_base (306)..(306): a, c, t, g, unknown or other
  modified_base (355)..(355): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggacagccacctctcctgcagggccagtcagagtgtgagcagcaacttagcctggtatcagcagaaacctggccaggctccaggctcctcatctatggtnccttccaccgagggccnctgggtcgtcccagccagattcgacggggcaggtcgggtctgggacagngttcactctcaccatcagcagcctgcagtctgaagtatttgctagtttattactgtcagtcactataaactaacgtcggggaccccgggggtacgttccgggaccgtaaggggaccgaagggtcggagatacgaaaacgtacgtcgtacggctcgcacgatctgtcttcacttcc

SEQ ID NO: 375724 - DNA, 624 bp, Homo sapiens
  misc_feature: GZ8MTXP02JZXP2.17.43.D10.1.454.CMB.2.raw
  modified_base (297)..(297): a, c, t, g, unknown or other
  modified_base (607)..(607): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggaccaggcctcccaggcctcctcatctagtggtcnccttaccaccgcgggccgtctcgggtcgtcccgagcccgagtacttcggacggggctagggttggggtaccgtggggaccaggtcggtttccaacgttcctacaaccgtatcgagccaggccctgtaccagttctagtaagttattttcgacttagttttaacttacgtgttaccagactaacttaacgtaaacgtaccggttccgggggacccccgggggtacgttaccgggacccggtaagggaccgaagggtacggacgtaacgtacgaaacgacgttcggtacggcctaggaaccaccgtatcgtntccttacacgtttcccg

SEQ ID NO: 375725 - DNA, 647 bp, Homo sapiens
  misc_feature: GZ8MTXP02H28MX.17.43.D10.1.454.CMB.2.raw
  modified_base (311)..(311): a, c, t, g, unknown or other
  modified_base (401)..(401): a, c, t, g, unknown or other
  modified_base (428)..(428): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacacgccaccctctcctgcgagggccagtcagagtgtgagcagctaacttacgcctaggtactcgagacacgaaacctcggaccgacggcctcccgaggctcctcactctagtggtcncctccgacgcgggctcgtggtcgtccagccagtatcgaggggctagggtcgggacgtggacgagtcgttcactctacaccatcacgaccngcctgacctaggtctagaaacggtttntttcgatttatttacgtcttgtacaacgtactaaagtacgttaaccgggtacggggtaccccggggggtacccgggggttacgtaccggggaaccggtaaacggggtacggaaggggtacggtaaaacgtaccgtaaaacggtaaacggtaacgttcggggcgtcgtaacgaacccgtacgttacggtttcgttccgtttacctacgtttaccctcccg

SEQ ID NO: 375726 - DNA, 815 bp, Homo sapiens
  misc_feature: GZ8MTXP02JC9YF.17.43.D10.1.454.CMB.2.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtcttgttctccgaggggaacacgcccaccctctccgtgcgagggccagtcagagtgtgagcagactaacttagccgtggtatcagcaacgaaaccgtggaccacggccctacccgaggtccctaccgtactagttcgtaagtcgggtcactacgttacccgtaaccggacggggacctacgggttcggtaccgttaccccgagtcccgtaaggggttcacgggttcggccgtaggggtttcggggacgttacgggggaacttacgggttacgtttccctacgttaccttctaaacgtcctaaacttccgaacggttcccacccggtcccgttaggtcgtaacggttcgttaaagggttaaagttttaagggtttttcccggttaaggtttttaaacttaccgggtttcgttaccgtaacgtaacgtttaagggtttaaaacttaacgtacgggtttcgggtaacccgggtttccccgttacggggttaccgggtaaccgggttaacccggaaacccggggttaaaacggggtaaacccggtaaaaggggttaaaacggaaaacgtttaaaccggaaaaaccggttggttacggtaaccgggtcaaccggtcccctaaagtactttccgtagtttacccc

SEQ ID NO: 375727 - DNA, 670 bp, Homo sapiens
  misc_feature: GZ8MTXP02JLU0Z.17.43.D10.1.454.CMB.2.raw
  modified_base (185)..(185): a, c, t, g, unknown or other
  modified_base (227)..(227): a, c, t, g, unknown or other
  modified_base (429)..(429): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggacagccaccctctcctgcagggccagtcagggtntgagcagcaacttagctggtatcagcagaaactggaccaggctcccgaggcctcctcatcctatggtcgtccttaccgaccgtacgggccgtcgtcggtcgttccccgagcccgagtacttcgggaggggccaggtggggtctaggggacaggacgttcactcctcgacatcagccagccgtagcgtagtcgtagaaagttntttgtacgttagtttacgttacttacggtactagactaagtaattaaacgtaccgggtaccgggggtcccccggggggtaagttaccggggacccgtaaacggggaccgtaaaggggtaccggaaagtaaccgttacggaaaaacccgggtagttaacgggtcggtaacccgttacggacaaacccgttcggttaccggttcgttacccgtttacctaacccggtttcccgtttaaccccg

SEQ ID NO: 375728 - DNA, 688 bp, Homo sapiens
  misc_feature: GZ8MTXP02J3EQZ.17.43.D10.1.454.CMB.2.raw
  modified_base (145)..(145): a, c, t, g, unknown or other
  modified_base (184)..(184): a, c, t, g, unknown or other
  modified_base (194)..(194): a, c, t, g, unknown or other
  modified_base (251)..(251): a, c, t, g, unknown or other
  modified_base (489)..(489): a, c, t, g, unknown or other
  modified_base (526)..(526): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggcctcccagatactactgganaaatggtgatgacgcagtctccagccacctgtctgttcncgaggggacngccacctctctgcgagggccagtcagagtgtgagcagctaacgttcgccttggtacncagacaagaaccgtcggaccacggcctcccgaggtcctaccgtactacgtccgtagttcgggttctcccgttacccgaacccgggtcggggtccccgtgttaccggggtacctacccgacggcctaaggtcgttccggagggggtacctggggttcgggtccgtagggacccttagggtaccttccaaccgttccaccgacccagttaccacggactaacggtccctagacgtacgtntagggtaatttcgtttgaccgtttatttacaccggtntacgatcctaaattaacggtaaccggtccgggccccggggggtaaccccgggtattacccggggaaacggtaagaaccgggtagtacggaactaacgaaccgtaaacgttgcggacgacttaaccgcaaacgttgtcgttacctcttaccgacttttccccg

SEQ ID NO: 375729 - DNA, 648 bp, Homo sapiens
  misc_feature: GZ8MTXP02JIS8B.17.43.D10.1.454.CMB.2.raw
  modified_base (298)..(298): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagcccaccctgtctgttctccgaggggaacacgcccaccctctcctgcgacgggccagtcgaggagtgtgagcagctaacttgcctggtatcaagcaacgaaaccgtggaccaggcctcccgaggcctcccnagttctagtcggtcgtcccttaccgaccgtaggggcccgtcgtcgggtccgtacccgacggccctaaggtacgttaccggacgggggtactacggggttcgggtcggtagggacagggtcgttccaacgttccaccacgatcgacgtcacgcctagcagttcgtagtaacgttatttcgtacgttatttattacgtgtacgagtccaattaacgttaaagtaccgggtacccgggggaccccgggggtagttacccgggaacgtaacggacgtaaggacggaagacgaaaccgtaaagacgttggacgtcaggtccaacgtctacgttccgtacttacctacgtttcccg

SEQ ID NO: 375730 - DNA, 669 bp, Homo sapiens
  misc_feature: GZ8MTXP02HTJB4.17.43.D10.1.454.CMB.2.raw
  modified_base (232)..(232): a, c, t, g, unknown or other
  modified_base (236)..(236): a, c, t, g, unknown or other
  modified_base (246)..(246): a, c, t, g, unknown or other
  modified_base (266)..(266): a, c, t, g, unknown or other
  modified_base (279)..(279): a, c, t, g, unknown or other
  modified_base (317)..(317): a, c, t, g, unknown or other
  modified_base (427)..(427): a, c, t, g, unknown or other
tcagcgtagactagcacgaccggtgctcgatttagactagcagtaaggggacataacaaccacattcctcctctaaagaagcccctgggagcacagctcatcaccatggactggacctggagttcctctttgtggtggcagcagctacaggtgtccagtcccaggtgcagctggtgcagtcgaggggctgaggtgaagagccgtgggtcctggtgaaggtctcctgcaaggnttcnggagcaactnagtactattatgtggtacgnacggccctggacngggtctgagtggacgtggggaggtactcgtacttccgngttccgtcttagggttaccgaactaaacgttaccgcgtaaacacggtacgttacccggagggacctaggtaccgtacgacgtaacgttacccggacgaaacccgttaaanaccgtaaacgaaccacacgtacctaactagtacgtactacaactaactactacgtagaactcgtcgtaggaaccgtacgtacggtttctttaacgtcgtacgtacggacgaacgtacgtactaaacgtcgtacgtaacttttacccgttaacttcggtttacgaccggtaacggttcccggggaaccgtaaacccggggttacccttcggaccgtaccggtttaccctaccggtaacgcccg

SEQ ID NO: 375731 - DNA, 615 bp, Homo sapiens
  misc_feature: GZ8MTXP02IFH45.17.43.D10.1.454.CMB.2.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccacctctcctgcagggccagtcagagtgtgagcagcaacttagcctggtatcagcaagaacctggccaggcctcccaggcctcctcatctagtggtctccttccgaccgaggggcccgcgttgggtcgtcccagccagtacttcggaggggtcagggtggtccgtgggacaggtcgttcactctacaccatcagcagcctgcagtctagtaacgttatttcgacttagtttattacgtgttacgacgtacaacttagttaaacgtaaccggtccgggggacccccgggggtaagttacccggggacggttaaaacggggaccgtaaggggttagggaacgtacgtaaacgaaaacggacttggggtacgtcgttacggaacgacccttagtccgtagttccttacgactttccccg

SEQ ID NO: 375732 - DNA, 569 bp, Homo sapiens
  misc_feature: GZ8MTXP02GTNUT.17.43.D10.1.454.CMB.2.raw
  modified_base (304)..(304): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagcccaccctctcctgcagggccagtcagagtgtgagcagcaacttagcctggtatcagcagaacctggccaggctcccaggctcctcatctatggtgccttccaccgnggggcccgctgggtcgtccccagccagtacttcgagggggcaggtggggtctggggacaggtcgttccacgttctccaccatcagcagcctgcagtctagaagtattttgacttagtttattacttgtactagtctaacttaataaacgtaaccggtcggggacccccggggggtacgttccggggaccgaacggggaccgaagggtcggagacgtacgaaacgaacgttggacggctcgcgacactctcgtcttcactttcccg

SEQ ID NO: 375733 - DNA, 591 bp, Homo sapiens
  misc_feature: GZ8MTXP02F9A54.17.43.D10.1.454.CMB.2.raw
  modified_base (185)..(185): a, c, t, g, unknown or other
  modified_base (296)..(296): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagcccaccctctcctgcagggccagtcagagtgtgagcagcaacttagcctggtatcagcagaaacctggaccaggctcccaggctcctcatctatggtnccttccaccgagggccgctgggtcgtcccagcccagtattcgaggggcaggtgggtctggggacaggtcgttcactctacaccatcagcagcctgcagtctagagtattttgcgtagtttattactgtcagtcaatataaagtaaccgtcgggggacccccggggggtagttccgggaccggtaaacggggaccgtaaaggggtcggaacgtacgtaacgaaaaccggtaacgtacggtacggcgtacgaaccgtaaccgaacgttcgttacgtcctttacctaactttcccccg

SEQ ID NO: 375734 - DNA, 644 bp, Homo sapiens
  misc_feature: GZ8MTXP02F05XK.17.43.D10.1.454.CMB.2.raw
  modified_base (183)..(183): a, c, t, g, unknown or other
  modified_base (227)..(227): a, c, t, g, unknown or other
  modified_base (297)..(297): a, c, t, g, unknown or other
  modified_base (316)..(316): a, c, t, g, unknown or other
  modified_base (429)..(429): a, c, t, g, unknown or other
tcagcgtagactagcacgaccggtgctcgatttagactagcagtaagggggggaactgctcagttaggacccagacggaaccatggaagccccagcgcagcttctcttcctcctgctactctggctcccagatactactggagaaatggtgatgacgcagtctccagccacctgtctgtttcnccgaggggaacagccaccctctcctgcagggccagtcagagtgngagcagcaacttgcctggtatcagacagaaacctggccaggcctcccgaggcctccgtcattctatggtnccttccgaccgacgggccncgtcggtcgtcccagccaagtacttcggaggggtccgagggttcgggtacgtggggacaggtagttcactctacacctatcgagcacgccgtgacgtagtctagtaaagtttntttagtacgttagtttactagttacgtactaagtactaaacgttaagttaaaccgggtacccggggtaccccgggggtaccccgggggtacgtaccgggaaccggtaacggggtaacggaagggtaacggaacgtaacgtaaaccggaaacggtacgtacggtacgtacgtacgactaacgttcttcgtacgttcctacgtccgttcccgtaccg

SEQ ID NO: 375735 - DNA, 677 bp, Homo sapiens
  misc_feature: GZ8MTXP02HS13F.17.43.D10.1.454.CMB.2.raw
  modified_base (183)..(183): a, c, t, g, unknown or other
  modified_base (224)..(224): a, c, t, g, unknown or other
  modified_base (435)..(435): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgttcncgagggacagccacctctcctgcgagggccagtcagagtgngagcagaccaacttagcctggtactcgagcaagaaacctggccagggcctcccgaggcctcctcactcgtagtggtcgccttaccgaccgacggggcccgtcgttacgggtccgtaccccgacgcccgtaaggtacgtttcggaacgggggcctaggggtcggggtaccgtaggggaccgtaggtacgtttccaacttcctaccgacctanacacgctacgcctagctacgttcgtagtaaagttattttgacgtttagtttattacgtgttacgtacgtactaagttaacttaacgtaaccggtccgggggtacccccgggggttagttacccgggaccggtaaacgggaccgtaagggtacggaacgtaacgtaacgaaaacggtacgtcggttacgacgttacgaacctacgtacgttccgtacgtttacccgttactaccgtttccccg

SEQ ID NO: 375736 - DNA, 713 bp, Homo sapiens
  misc_feature: GZ8MTXP02IU3O1.17.43.D10.1.454.CMB.2.raw
  modified_base (184)..(184): a, c, t, g, unknown or other
  modified_base (222)..(222): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggacagccacctctcctgcagggccagtcagngtgtgagcagcaacttagcctggtatcagcaagaaaccctggaccaggcctcccgaggcctcctcacgtctagtggttcgtccttaccccgaccgacggggtcccgcgttcgggtccgtcccagccgtaggtacttcggacggggctaggtgggtacgtagggacgtagtcggttccactccgtaccaacctgtccgagaccgtagccgtgacgtagtcgtagtaagttagttttacgacgttaagtttaacttacgttacgtaccgtaagtaccttaaacgttaagtaaaccgttaaccggggtacccgggggtaacccccggggggttacgttaacccggggaacccggtaaaacgggggtaccggtaaacggggtaacgggaaacgtaccgtaaaccggtaaaaccggtaaccggttaggtacggtaccgttacggaacctaacccgtaacgttcgttacgttaccgtttacctaacttttcccccgg

SEQ ID NO: 375737 - DNA, 834 bp, Homo sapiens
  misc_feature: GZ8MTXP02FNXZS.17.43.D10.1.454.CMB.2.raw
  modified_base (300)..(300): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagcctggtatcagcaagaaacctggaccaggctcccgaggcctcctcatctagtggtcnccttccgaccgaggggcccgcgtcgggtcgtccccgagcccagtacgttcgacgggggtctaggtggggtaccgtggggaaccaggtcgttccgaaccttcgtaccaaccctagtccaagccgacgtcccttagactacggttccgtaggtaaacgttttacgttttttttaccgtaaaggttttttaactttaaccgttacgggttacctaaacggtacccttaaaccgtttaaaacgtttaaaaaccggtttaaaaccccggggttccccgggggggtaacccccccccgggggggggggtttaaacccggttttaacccggggggaaacccccgggtaaaacccggggggtaaaacccccgggtaaaagggggtttaacgggggaaaaccggttaaaaccggttaaaacccggaaaaaacccggtaaaaccggtttcgggtacggggtaccgtacgtaaccccgtaacccgtacgtttacccgttacggtttaccctttaccttaaccgtttcccccgtttaaccccccgg

SEQ ID NO: 375738 - DNA, 724 bp, Homo sapiens
  misc_feature: GZ8MTXP02IF32X.17.43.D10.1.454.CMB.2.raw
  modified_base (702)..(702): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagcccacctgtcttgttttctccgaggggaacgacgcccaccctctcctgcgacgggccagtcagagtgtgagcagctaacttgccgtggtatcagacaagaaacctggaccacgggtcctcccgacggtcctccctctatctagtggtctccttacccgaccggcgggccgtcgtcgggtccgtcccacgaccgagtacgttcggacggggccgtagggtggggtacggttgggaacgacggttacgtttccgaccgtttacctacccgtaccctacgttaccgaaacgtccgtacgcccgttacgccgttaaacgggttccgttaaggttaaagttttacgtttttacgggtaaccttttaggtttaactttacgttcgttaaccgacgttaccttaaaacgttaacgttaaaacggtaaccgggttccccggggggtaccccggggggtacttaaccggggacggtaaacgggaaccgtagggtacggaacgtacgaaacgtaaacgacgtcggacgtcgacggctaaccgtntttctacgtccttctacgtccc

SEQ ID NO: 375739 - DNA, 750 bp, Homo sapiens
  misc_feature: GZ8MTXP02FNBK3.17.43.D10.1.454.CMB.2.raw
  modified_base (183)..(183): a, c, t, g, unknown or other
  modified_base (192)..(192): a, c, t, g, unknown or other
  modified_base (203)..(203): a, c, t, g, unknown or other
  modified_base (218)..(218): a, c, t, g, unknown or other
  modified_base (442)..(442): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgttcncgagggacngccacctctcngcagggccagtcagngtgtgagctagctaacgttagccttaggtactcacggacaacggaaacctggggacccagggccctaccccgaggccctcctcattccgtagtgggtctccttacccgaacgcggggtcccgcggtaggtccgtcccgaggcccgtaggtacgtttcgggaagggggcctaggggtggggtaccgtaggggaactaggtcgttccaccgttctaccgaacctanaccgacgccgacgtccgtacgacgttaggtactaaggtaacgtttattttacggtaactttaacgttttaacttacgttacggtaacctacgtaaccttaaacgtttaaacgtaacgggttaaccccgggggtacccggggggtaacccccggggggttacggttaacccggggaaccgggtaaaccgggggtaacggaaggggtacggtaaacggtaaacgtaaaccggaaaacggttacggtcggtacggtacgtacgtaaccgtacctacgttaccgttacgttaccttaccgtaccgtttcccg

SEQ ID NO: 375740 - DNA, 583 bp, Homo sapiens
  misc_feature: GZ8MTXP02I72O4.17.43.D10.1.454.CMB.2.raw
  modified_base (277)..(277): a, c, t, g, unknown or other
  modified_base (286)..(286): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccaggggacagccacctctcctgcagggccagtcagagtgtgagcagcaacttgcctggtatcagcagaacctggccaggctccaggctcctnatctatgtnccttccaccgagggccgctgggtcgtcccagccagattcgaggggcaggtggtctgggacagtgttccactctccacatcacgcacgcctcgcgacgtcgtagtaagtagtttgtacgttagtttacgttacgttacgtacgtagtactaactaagtaaactaaccgtaccggggtaccccgggggtaccggttaccggaccggtaacgggaacgaacggtaggtaggacgtaacgaaacgtacgtaaaaacgtcgtacgtacgaacgacacgtcgtacgtaccgtactacttcccg

SEQ ID NO: 375741 - DNA, 688 bp, Homo sapiens
  misc_feature: GZ8MTXP02FM38Z.17.43.D10.1.454.CMB.2.raw
  modified_base (184)..(184): a, c, t, g, unknown or other
  modified_base (194)..(194): a, c, t, g, unknown or other
  modified_base (301)..(301): a, c, t, g, unknown or other
  modified_base (457)..(457): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttcncaggggaacngccaccctctcctgcacgggccagtcagagtgtgagcagcctaacttgccttggtatcagcaagtaaccgtggaccaggcctacccgaggcctccgtacatcttagnggtctccttacccaaccgcgggccgacgtcgggtctcccgagtccagtacgttcggaggggcctaggtcggggtacgtggggaactagttcgtcctcttaccacctactacgacaggaccgacgtcccagcctagttaccgtagtaaacggttttntttacgtaacgtttaacgtttattacgtagtaccacgttactaaacgttaacgttaaaccggtaccggggtacccgggggtaccccgggggttacgtacccgggaacgggtaaacggggaccgtaagggttacgaacgtaaaccgtaacggtaaacggtacgttacgggtacctacggtacgtccgtaacttacgtttaccgtcgtttaccgttaccgttaccgttccccg

SEQ ID NO: 375742 - DNA, 768 bp, Homo sapiens
  misc_feature: GZ8MTXP02IHVDJ.17.43.D10.1.454.CMB.2.raw
  modified_base (185)..(185): a, c, t, g, unknown or other
  modified_base (225)..(225): a, c, t, g, unknown or other
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagccaccctctcctgcgaggccagtcagngtgtgagcagactaacttacgccgtaggtatcgagcaagaaaccgtggacccagggccctcccgaggtccctcctacgacttcgtaggtcgggttctacccgtttccccaaccgggtcggggtccccgtcgttcggggtaccgtacccccgaacggtcccgtaaaggtacgtttccggaagggggcctaggggtttcggggtaccgtaggggaacctacgggtttacggttacccgtacggttaccctacccccgtaacgtacgtccgaaagtccgtaccgtcgtaccgcgtacggttacgtagtaagtttacttttacgacgtttaagttttacgttacgttacgtacgtaacgtaccttaacgttaaacgttaaaccggtacccgggggtccggggggaccccccgggggttaggttaaccccggaccgggtaaaacgggaccggtaaacgggtacgggtaacgtacgaaacggtaaaaccggcgttacggggcgtactacgaaccgtaacgtctcggtttactctttacaccggtttccc

SEQ ID NO: 375743 - DNA, 566 bp, Homo sapiens
  misc_feature: GZ8MTXP01D4ELB.44.9.A09.1.454.CMB.2.raw
  modified_base (254)..(254): a, c, t, g, unknown or other
  modified_base (296)..(296): a, c, t, g, unknown or other
  modified_base (351)..(351): a, c, t, g, unknown or other
  modified_base (493)..(493): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagccctntggattcatcttcaggacctatcgccatgcacgtgggtcccncaggctccgaggcaagggggctgggagtggggtgacaaagttatatccaaggaanagtggaaattagaaagaacacgtaacgggaagacctaccggaaggaaacgggcccattcaccgtctacgagacgacaataccacggaacacacagcatctgacaaatgtaaccaacctacaacaagtagaggacacggttcngttactattagttgtcgcgacgaccgcccctacggaacggacccggtcccgttacgttccgaacgtaaccggg

SEQ ID NO: 375744 - DNA, 573 bp, Homo sapiens
  misc_feature: GZ8MTXP01COHD9.44.9.A09.1.454.CMB.2.raw
  modified_base (255)..(255): a, c, t, g, unknown or other
  modified_base (394)..(394): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagattgggttttcctcgttgctcttttaagaggtggccagtgtcagatgcagctagtggagtcgtgggggagagcggcccagcctgggaactccctgagactctcctgtgcagcctntggattcatctcaggacctatgccatgcacgtcgggtcccgccaggcctccgaggcgaagggggctgggaggtggggtgactaagttatacgtcgaggaagtagtaggaaaatttaggaagaaactaacgtaacggganaccgtacgggagaacgggaccgattcaccgtctaccgagagacaactaccgaaggaacacactgacatctcgacaaatcgaaccaacctacaactaagtagacgacgaacggcttgtcttagttagtgttcgcgacgtaaccgccccgtcgacggaccggttcccgtcgttcgtaaccg

SEQ ID NO: 375745 - DNA, 550 bp, Homo sapiens
  misc_feature: GZ8MTXP01D30HO.44.9.A09.1.454.CMB.2.raw
  modified_base (327)..(327): a, c, t, g, unknown or other
  modified_base (365)..(365): a, c, t, g, unknown or other
  modified_base (489)..(489): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatgggaagtacttatttgtattggtacctacagaggccaggccagtcgccgcagctcctagtccaacaggttccagccgtcttttcnggagtgtcagacaaggatcagtgctcggctcagaaacngtattcacactgacaatcagccgcgtggagctgcggggtatgcttggttgtttattacgtgcctttgctaagtctttagaacccggttacttacgttttcgggaccgtaacgggggtccccggngttggggaacggttccgaaaacgtttcggaaaccgttggttacggggtccttggtaacccc

SEQ ID NO: 375746 - DNA, 572 bp, Homo sapiens
  misc_feature: GZ8MTXP01ALG0B.44.9.A09.1.454.CMB.2.raw
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgctcttttaagaggtggccagtgtcagatgcagctagtggagtcgtgggggagagcggcccagcctgggaactcctgagactctcctgtgcagcctctggattcatctcaggacctatcgccatgccacgtcgggtcccgccaggcctccgaggcgaagggggctgggagtggggtgactaattatactcaagaagagtggaaaattggaagaacacgtacggagacgtcgaagaacgggccattccacgtctaccagacgacaacttaccgaaggaaaccacacgtcgacactctacgacaaatcgtaaaccaacctacaacgtaaaggtgaacggacaacgggtcttgtacttagttagttgttcgcgacgaaccgccccgtaacggacgacccggttcccgtcgttcgaacccg

SEQ ID NO: 375747 - DNA, 614 bp, Homo sapiens
  misc_feature: GZ8MTXP01DMQWG.44.9.A09.1.454.CMB.2.raw
  modified_base (297)..(297): a, c, t, g, unknown or other
  modified_base (387)..(387): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagattgggttttcctcgttgcttcttttaagaggtggccagtgtcagatgcagctagtggagtcgtgggggagagcggcccagcctgggaactccctgagctctcctgtgcagcctctggattcatctcaggacctatcgccatcgcacgtgggtcccnccaggcctccgaggccgaagggggctgggagtgggtgactaattatatcgaagaagatagggaaaacttgaagaaacaacgtacgggaanaccgtcggaaggaacggccgacttacaccgtctaccagaagacaattaccgaaggaaccacactcgacgaatctagacaaatcgtaaccaacctacaacgtaaagtacggaacggaaccgaacgggtcttacggttacttaagttaacgttggttacggcgaacggtaacccgccccccgttaacggaccgggtaccccgggttccccgtccgtttcggtaacccgg

SEQ ID NO: 375748 - DNA, 541 bp, Homo sapiens
  misc_feature: GZ8MTXP01ERXJO.44.9.A09.1.454.CMB.2.raw
  modified_base (226)..(226): a, c, t, g, unknown or other
  modified_base (248)..(248): a, c, t, g, unknown or other
  modified_base (269)..(269): a, c, t, g, unknown or other
  modified_base (328)..(328): a, c, t, g, unknown or other
  modified_base (345)..(345): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggancctcttacatactaatgggaanacttattgtattggtacctanagaggccaggccagtcgccgcagctcctagtcccagcaaggttccagccgtcttttccnggagtgtcagaacaggntcgagtcggctccgggctcaagaaacagtattcacactagaacaatcacgccgcgtggagctggggcggatgcgttggttgtttattactgtcttgactaagtcgtttaacgaccgttactacgttttcggcccgtaagggggcccggttgttcgggtaaggtacaacgttcggaacgttggtaacggcgtaaccg

SEQ ID NO: 375749 - DNA, 551 bp, Homo sapiens
  misc_feature: GZ8MTXP01BPEKA.44.9.A09.1.454.CMB.2.raw
  modified_base (269)..(269): a, c, t, g, unknown or other
  modified_base (328)..(328): a, c, t, g, unknown or other
  modified_base (345)..(345): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatgggaatacttattgtattggtacctanagaggccaggccagtcgccgcagctctagtccagcaaggttccagtccgtcttttccgnggagtgtcagaacaggntcaggtcgctccggctacgaagaaacagtatttcactactagaacaatcacgccgcgtggagcgtggggcggagtcgtcgttggttgtttagttacgtgtcttgactaagttccgtttaaggaccggttattaccgtttcgggacccggtacggggccccggttgttacgggtaagtacgtaacgtaccgagttggtcgcgtaacg

SEQ ID NO: 375750 - DNA, 595 bp, Homo sapiens
  misc_feature: GZ8MTXP01EW2G8.44.9.A09.1.454.CMB.2.raw
  modified_base (227)..(227): a, c, t, g, unknown or other
  modified_base (331)..(331): a, c, t, g, unknown or other
  modified_base (350)..(350): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactcttctctgtctgtcacccctggacagtcggcctccatctcctgcacgtctgatcggancctcttacataactaatgggaaatacttattgtatttggtacctacagaggccaggccagtcgccgcagctctagtcccagcaggttccagccgtcttttccgnggtagtgtcacgaacaggntcgagtcggctcgggctcaagaaacagtattacacatagaacaatacgacgccgcgtaggagcgtggggcgtagtgtcgttggttgtttaagttcgttgtcttcgacgtaagtccgtttaacggtaccggttaacgttaccggtttttacgggacccgggtaaccgggggttaaccccgggttcgttacggggtaacggttaccgaacgttaccggtaaaccgttcggtgggttccgttaaccgg

SEQ ID NO: 375751 - DNA, 788 bp, Homo sapiens
  misc_feature: GZ8MTXP01A2RM9.44.9.A09.1.454.CMB.2.raw
  modified_base (253)..(253): a, c, t, g, unknown or other
  modified_base (308)..(308): a, c, t, g, unknown or other
  modified_base (359)..(359): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagattgggttttcctcgttgcttcttttaaggaggtggccagtgtcaggtgcagctaggtggagtcgtgggggagagccggccagcctagggaacctccctgagctctcctgtcncagccctgtggattcattcttcgacggtacctatcgccatcgcacgtgggtcccncgaggcctaccgaggcgaagggggctagggaggtggggtcgactaaattanactaccgaaggaaagtagtacggtaaatttaacgggaaagaaccgtaacggtaaaccgggaacgtaacccgtacccgggaaaggggaaaccggggtacccgtaacgtttacccggaaccccgttacgtacccgtaaagggtaaaccgaaaccggtaaacctttaccggaaaccgggtaaaacccaaccgaaccgttacggacccgtaaactacccgttaaggtaaacctaaaaacggttacccgttaaacccgaaaccccttaccgtaaaaccgtaacgggtaaggaaaccggtaacccggaaccggtaaccggtttagttaccgtttaatttaaccgtttggtacgttaccggacgttaacccggtcccccgttagggaaccggtaccccggtcccgttaccgttcggttaacccgttaacccggggg

SEQ ID NO: 375752 - DNA, 660 bp, Homo sapiens
  misc_feature: GZ8MTXP01B802R.44.9.A09.1.454.CMB.2.raw
  modified_base (297)..(297): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaactccctgagactctcctgtgcagcctctggattcatcttcaggacctatgccatgcacgtgggtcccncgaggctcgaggcgaagggggctgggagtggggtgactaaagttatataccgaaggtaaagagtagggaaatttaggaaaacgaacacgtaaacgggagaccgtccggaagggaacgggccgtattccgaccgtctaccaagaacgaacaactaccaaggaaaccacactgactatctagacaaatcgtaaaccaacctacaaaccgaagtacggaacggaaccgacgggtaaccttaggttacttaacgtttacgttaggtacgttacccggttacggaaccccggtcccccgttaccgggaaccgggtaaccccgggttcccccggttacgtttaacccgggaacccgtttaacccggggg

SEQ ID NO: 375753 - DNA, 648 bp, Homo sapiens
  misc_feature: GZ8MTXP01EI33D.44.9.A09.1.454.CMB.2.raw
  modified_base (345)..(345): a, c, t, g, unknown or other
  modified_base (365)..(365): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcaccctggacagtcgcctccatctcctgcacgtctgatcggactccttacttaacataactaagtggggaaatacttatttgtattaggtaacctagagacggccaggccagtccgcgcacgctcctagtcccagctaaggttccagtccgttcttttaccggnggtagtgtacagaacgaggntacgaggtcggccgtccggtactaacgaaacgtaaactacgtacttacactacgtacgtaactaacgtacgacggccggtacggtacgggacggtcgtacggggtacggtagttcggttacggtttggtttagtttacgtttacgttgttcgttacgtacgtaacgttaccgtttaacggttaccggtttacgttacggtttccgggacccgggtaaccggggttacccgggttcggttacgggtaacggtacgtaacgtacggtacgttcggtcgttcgtcg

SEQ ID NO: 375754 - DNA, 640 bp, Homo sapiens
  misc_feature: GZ8MTXP01APON3.44.9.A09.1.454.CMB.2.raw
  modified_base (297)..(297): a, c, t, g, unknown or other
  modified_base (331)..(331): a, c, t, g, unknown or other
  modified_base (340)..(340): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagattgggttttcctcgttgctcttttaagaggtggccagtgtcaggtgcagctagtggagtcgtgggggagagcgacccagcctgggaactccctgagactctcctgtgcagcctctggattcatcttcaggacctatcgccatgcacgtgggtcccncaggctccgaggcgaagggggctgggaggtgggngacaattanatcaaggaagatagggaattaggaaagaacacgtaacgggagtaccgtaccggaagggaacgggccgacttaccgacccgtctaccgaaggaacgaacctaacgttaccgaacggaacaacactacgcaactcgtagacaaactacgtaaccaacctacaaacaacggtacggaacggaccgacgggtcttcggttacttaacgtttagttaggtcgttaccggacgacccggtaacccccgtacgggaaccggtaccccgggtccccggttacgttaaccggttaaccgttaacccggg

SEQ ID NO: 375755 - DNA, 502 bp, Homo sapiens
  misc_feature: GZ8MTXP01ELQFO.44.9.A09.1.454.CMB.2.raw
  modified_base (344)..(344): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatgggaagactatttgtattggtacctacagaggccaggccagtcgccgcagctcctagcccagcaaggttccagccgcttttcctggagtgtcagaacagggntcagtggctccggctcagaaacagatttcacatgacaatcacgcgcgtggagctgggcgatgctggtgtttatactgcttgcagtcttgtaccggttacgattttcggcgtacggggaccggcgttcgggaaggtcaagtcgaacgttgtcgggctcg

SEQ ID NO: 375756 - DNA, 653 bp, Homo sapiens
  misc_feature: GZ8MTXP01DBBPX.44.9.A09.1.454.CMB.2.raw
  modified_base (300)..(300): a, c, t, g, unknown or other
  modified_base (371)..(371): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatcctggattgagtgcggatattgtggtgacccagactccactctctctgtctgtccaccctggacagtcgcctcatctctgcacgtctgacgtcggactccttacttacaataactaagtagggtaatacttattgtattacggtaacctagagaggccaggccagtccgccgnacgtctcctagtccaagacgtaacggttccacgtccgtcttttccgaggtagttgacgagaacgaagggtntcgaggtcggcgtccggactacaaagaaacatattacaacactagaaacaagtcgaacggtccggcgggtagggacggtcgtacgggggtacggtaggttcggttacggttaggtttagtttacgttacgttacgttacgttacgtacgttaacgttaacggtttaaccggttaaccggttaccggttaccggtttaccgggtaccgggtaccggggttacccgggttcggttacgggtaacggtacgtaacgtacggtacggttacggtcggttcgtaacg

SEQ ID NO: 375757 - DNA, 819 bp, Homo sapiens
  misc_feature: GZ8MTXP01EDBM0.44.9.A09.1.454.CMB.2.raw
  modified_base (315)..(315): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagccggcccagcctgggaacctccctgacgactctcctgtcgcacgccctgtggattcatcttcacggtacctagtcgcctagtcgacctacggtcggggtccccnccgacggtcctcccggaaggggtaccgaaacggggggtccttaggggggtaacgggtggggggtaggtaaccttaaagtttaacgtacgtaccgaaaggtaaaggtagtaggggtaaaactttaaagggaaaacgtaaccgtaacggtaaaccggggaaacgtaaccgtacccggggaaagggtaaacggggtacccgtaacttacccgtaaccccgttacgtaccgaacgtaaacggaaaccctaaacgttacccgaaacggtaaacccaaaccgtaaccgttaacggacccttaacggttacgttaacggtaaacctaaaacgttaccgtaaacccctaaacccgtacgaaaaccgtaaggtaacggaacggtaaccgtacgggtaacctttgttaactttaagtttacgttaggtacggaccggttcggttaccccgtccccgtacggaaccgggtaccccggtccccgttacgtttaaccggttaaccggtaacccgggg

SEQ ID NO: 375758 - DNA, 567 bp, Homo sapiens
  misc_feature: GZ8MTXP01BQKVL.44.9.A09.1.454.CMB.2.raw
  modified_base (193)..(193): a, c, t, g, unknown or other
  modified_base (225)..(225): a, c, t, g, unknown or other
  modified_base (269)..(269): a, c, t, g, unknown or other
  modified_base (329)..(329): a, c, t, g, unknown or other
  modified_base (345)..(345): a, c, t, g, unknown or other
  modified_base (361)..(361): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtccaccctggacngtcgcctccatctcctgcacgtctgatcggancctctacatactaagtgggaatacttattgtattggtaacctanaggaggccaggccagtccgccgcagcctctagccagcaaggttccagtccgtcttttcgnggagtgtcagaacagntcgagtcggctccggntacgaaagaaacagtattacaactactagaactatcacgcgcgtggagtcgtggggcggtagtcgtgttggttgtttacttacgttgtcgttagactaagtcgtttaacggtaccgttacgttacggttttcggacccggtacgggggacccgttcggttggggtaacgtaccgtaacgttcggtaacgttgggtcgttcgtaacg

SEQ ID NO: 375759 - DNA, 731 bp, Homo sapiens
  misc_feature: GZ8MTXP01AU9GB.44.9.A09.1.454.CMB.2.raw
  modified_base (257)..(257): a, c, t, g, unknown or other
  modified_base (301)..(301): a, c, t, g, unknown or other
  modified_base (358)..(358): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagattgggtttttcctcgttgcttcttttaagaggtggccagtgtcaggtgcagctagtggagtcgtgggggagagcggcccagcctgggaacctcctgagactctctgtcgcagcctnggacttcatctcgaggtacctatcgccatgcacgtcgggtcccnccgaggcctaccgaggccgaaggggggctgggacggtgggggtacgactaaatttanagtaccgaaggtaagaagtagggtaaacttaagggaaaacgaaccgtaaccggttaaaccgggaaagtaaccgtacccgggaaagggtaaaccggggtcccgtaacgtttacccgaacccggttaccgtaccgaacggaacgtaaaccgtaaacgttacccgaaacggaaccaaccgaacgtcgactacttacgtacgaacaaacttacgtaaacccgaaccttaccgaaaccgaagtacgggaacggacccgtacggtcttacgttaccttaagtttacgttagttaccggaccgacggttaccccgtaacccccgtggtaacccggtaccccgggttaccccgttcggttcccggaaccgttaacccgggg

SEQ ID NO: 375760 - DNA, 617 bp, Homo sapiens
  misc_feature: GZ8MTXP01EBKHS.44.9.A09.1.454.CMB.2.raw
  modified_base (333)..(333): a, c, t, g, unknown or other
  modified_base (355)..(355): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctcgtcacccctggacagtcggcctccatctcctgcacgtctgactcggatcctacttacatactaagtggaatacttattagtattcggtaacctagagacggcaggccagtcgccgcagctcctagtccagctagttccagtccgtcttttcgnggtagtgtcagaacgagtgtanaggtcgcgtccgcacgaacaaacagttacttacactactagaaactactcgacggcccggtgggtaggaacggtccgtagggggaccggtagttcggttacggtttgggtttattttacgttacttcggttcgttacgtacgttaacgttccgttttaaaccgggtaccgggtttaacctttaccggggtttcggaacccggggtacggggaccgttcggttagggtaacgtacgtaagtaccgagttcggtcgcgttaacg

SEQ ID NO: 375761 - DNA, 571 bp, Homo sapiens
  misc_feature: GZ8MTXP01A4GPW.44.9.A09.1.454.CMB.2.raw
  modified_base (226)..(226): a, c, t, g, unknown or other
  modified_base (272)..(272): a, c, t, g, unknown or other
  modified_base (333)..(333): a, c, t, g, unknown or other
  modified_base (350)..(350): a, c, t, g, unknown or other
  modified_base (412)..(412): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggancctcttacataactaagtggaatacttatttgtattggtaacctanagaggccaggccagtccgccgcagctcctagtcccagcaaggttccagccgtcttttccgnggagtgtcagaacaggntcgagtggactccgggactacgaaacgaaacagtactttacacactagaacaatcacgccgngtggaggcgtggggcggtagtcgtcgttggttgtttacgttacgtgtcttgactaacgtcgttaacgtacggttactacgtttcggacccggtacgggggacccgttcggttacgggtaacggtacgtaacgtaccggtacgttcggtcggttctccgg

SEQ ID NO: 375762 - DNA, 562 bp, Homo sapiens
  misc_feature: GZ8MTXP01D2K7X.44.9.A09.1.454.CMB.2.raw
  modified_base (276)..(276): a, c, t, g, unknown or other
  modified_base (337)..(337): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattggtggtgacccagactccactctctctgtctgtcacccctggacagtcggcctccatctcctgcacgtctgatcggatcctacttacataactaagtggaaatacttatttgtattcggtaacctanaggacggccaggccagtccgccgcagctcctagcccaagcaaaggttccagcctctttcgnggagtcgtcagaacaggctcgaggtgccctcgggactacgaaagaaacagtacttacgactactagaacaatcaagcccgtggtggaggtcgtggggcggagtgtcgttggttagtttattacgtgtcttgactaagtcgttaagacccggttattacgtttcggacggtacgggggaccgttcgttacgggtaacggtactaagtcgacgttggtcggctaacg

SEQ ID NO: 375763 - DNA, 841 bp, Homo sapiens
  misc_feature: GZ8MTXP01CHU4F.44.9.A09.1.454.CMB.2.raw
  modified_base (259)..(259): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagattgggtttttcctcgttgctcttttaagaggtggccagtgtcaggtgcagctaggtggagtcgtgggggagaggccggccagcctgggaacctccctgacgctctcctgtgcagcctntggattcatcttcgaggtacctagtcgccagtcgcctacgtcgggtcccacgacggcctccggaggcgtaagggggtctagggggaggttgggggtgtactaaagtttactaagtaccgaaagggtaaagtaggttaagggtaaaatttaaacgggaaaaaccgtaaccgtaaaccgggttaaacggggaacgtaacccggtaaccgggaaacggggaaacggggtaccccgttaacgtttacccgtacccggtacccgtaccccgaaggtaaacgtaaaccgttaaacgtttaaccccgaaacgggtaaacccgaacctaaccgttacgaacccgttaacgttaccgtaaacggtaaacctaaaacttaaccgtaaaaccccgtaaacccgtaacctaaaccggtaaaggtaaacgggaaccgggtaaaccggtaacggtaacccgtttaaggttaaccgtttaagtttaacgtttacggtcggaacggttaccgaccccggttaacccccggtaaccggaacccgggttaaccccggtcccccggttaccgttaaccggttaaccgggttaacccggggg

SEQ ID NO: 375764 - DNA, 577 bp, Homo sapiens
  misc_feature: GZ8MTXP02HNTCT.44.9.A09.1.454.CMB.2.raw
  modified_base (297)..(297): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaacctccctgagactctcctgtgcagcctctggattcatcttcaggacctatgccatgcacgtgggtcccnccaggcctccgaggcgaaggggctgggagtgggtgactaattatatccaagaagagtaggaattaggaaagacacgtaacgggagacctaccgggaagaacggggcccgaattccgaccgtctaccgagagaacaacttaccaaggaaccacactgccatctagactaaatcgaaccaacctacaacaagtagaacggacaccgggctagttctattaagttgtcgtcgagaccgtcccccgtcgacggtacccggtcccctacgttcgtacctaccggg

SEQ ID NO: 375765 - DNA, 522 bp, Homo sapiens
  misc_feature: GZ8MTXP02II4XT.44.9.A09.1.454.CMB.2.raw
  modified_base (226)..(226): a, c, t, g, unknown or other
  modified_base (327)..(327): a, c, t, g, unknown or other
  modified_base (343)..(343): a, c, t, g, unknown or other
  modified_base (392)..(392): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggancctcttacatactaatgggaagacttatttgtattggtaacctacagaggccaggccagtcgccgcagctcagtccagcaaggttccagccgtcttttccnggagtgtcagacaggntcagtgcctccggctacagaaacagatttcacactgaacatcaagccgngtaggagctgcggtatgcgtggttgtttatactgtcttgctaaagtctttacggaccggtttactacgttttggacgtacgggggtacccgtgtagggtaacggtcaacgtacgaacttggtcggctacg

SEQ ID NO: 375766 - DNA, 527 bp, Homo sapiens
  misc_feature: GZ8MTXP02HWZ9G.44.9.A09.1.454.CMB.2.raw
  modified_base (248)..(248): a, c, t, g, unknown or other
  modified_base (270)..(270): a, c, t, g, unknown or other
  modified_base (323)..(323): a, c, t, g, unknown or other
  modified_base (330)..(330): a, c, t, g, unknown or other
  modified_base (345)..(345): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctcatctcctgcacgtctgatcggagcctcttacatactaaatgggaanactttattgtattggtacctanagaggccaggccagtcgccgcagctcctagtcccagcaaaggttccagccgtnttttccnggatgtcagacaggntcagtggcctccggctcaagaaacagtattacacactgacaatcacgccgcgtggaggcgtgcggtagtgcgtggttgtttagttacttgcttgctagtactttacgaccggttactacgtttcggaccgtacggggcccggtcgtcggtaaggtcaacgtcgaacgtcggtacggtcgtcg

SEQ ID NO: 375767 - DNA, 697 bp, Homo sapiens
  misc_feature: GZ8MTXP02GK5GC.44.9.A09.1.454.CMB.2.raw
  modified_base (254)..(254): a, c, t, g, unknown or other
  modified_base (297)..(297): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagcggcccagcctgggaactccctgagactctcctgtgcagcctntggattcatcttcaggaccctatgccatgccacgtgggtcccnccaggcctccgagggcgaaggggctggggaggtggggtgactaaagttatatccgaaaggaagtagtaggggaaatttaggaaaagaaccacgtaaacggggaagacccgtaccgggaaaggaaacggggcccgtaatttcccgaacccggtcctacccgaaggaacgaacctaaacgttacccgaaaggaaacccacaacgttacgaccattccgtagaacctaaaagtcgtaaaacccaaccctaacgaaccgaaaggtcggaaaggaccgaccggtacttacggttacctttaaagtttacgttaggtcggtaaccggaacggtaaccccggtcccccgtaccgggaaccggtaccccgggttcccccgtacgttaccgtaaccgttaacccggggg

SEQ ID NO: 375768 - DNA, 500 bp, Homo sapiens
  misc_feature: GZ8MTXP02FXA6B.44.9.A09.1.454.CMB.2.raw
  modified_base (226)..(226): a, c, t, g, unknown or other
  modified_base (248)..(248): a, c, t, g, unknown or other
  modified_base (328)..(328): a, c, t, g, unknown or other
  modified_base (343)..(343): a, c, t, g, unknown or other
  modified_base (357)..(357): a, c, t, g, unknown or other
tcagacagtatatacacgaccggtgctcgatttagcgagacgcgcaagggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggancctcttacatactaatgggaanacttattgtattggtacctacagaggccaggccagtcgccgcagctccagtcccagcaaaggttccagccgtcttttccnggatgtcagacaggntcagtggctccggntcagaaacagattcacactgacaatcagcgacgtggaggctgcggatgctggtgtttattactgtcttgcaagtctttagaccggtactacgttttggccgtacggggacccgcgtggaaggtcaacgtcgaactgtggctcg

SEQ ID NO: 375769 - DNA, 510 bp, Homo sapiens
  misc_feature: GZ8MTXP02JN7F3.44.9.A09.1.454.CMB.2.raw
  modified_base (247)..(247): a, c, t, g, unknown or other
  modified_base (324)..(324): a, c, t, g, unknown or other
  modified_base (340)..(340): a, c, t, g, unknown or other
  modified_base (474)..(474): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatggaanacttatttgtattggtacctacagagccaggccagtcgccgcagctctagtccagcaaggtccagccgtcttttccnggagtgtcagacaggntcagtcggctccggctacagaaacagatttcacactgacaatcagccgcgtggaggctgcggatgcgtggtgtttatacgtgcttgcagtctttacgaccggttactacgtttcggaccgtacggggacccggngtcggaacgtacgaacgtcgaacgtcgtacggctcg

SEQ ID NO: 375770 - DNA, 499 bp, Homo sapiens
  misc_feature: GZ8MTXP02G27KF.44.9.A09.1.454.CMB.2.raw
  modified_base (247)..(247): a, c, t, g, unknown or other
  modified_base (291)..(291): a, c, t, g, unknown or other
  modified_base (322)..(322): a, c, t, g, unknown or other
  modified_base (329)..(329): a, c, t, g, unknown or other
  modified_base (344)..(344): a, c, t, g, unknown or other
  modified_base (357)..(357): a, c, t, g, unknown or other
  modified_base (366)..(366): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatggaanacttatttgtatttggtacctacagaggccaggccagtcgccgnagctcctagtcccagcaaggttccagccgtnttttccnggatgtcagacaggntcagtgctccggntcagaaacngattcacactgaacaatcagccgcgtggaggctggcggatgctggtgtttatactgtctgacagtctttagaccggtatacgtttggccgtacggggacccgcgtggaagtcaacgtcgaacgtgtcggctcg

SEQ ID NO: 375771 - DNA, 548 bp, Homo sapiens
  misc_feature: GZ8MTXP02IEN4J.44.9.A09.1.454.CMB.2.raw
  modified_base (256)..(256): a, c, t, g, unknown or other
  modified_base (296)..(296): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctaggtggagtcgtgggggaggagcggccagcctgggaactccctgagactctcctgtgcagcctntggattcatcttcaggacctatgccatgcacgtgggtccncaggctccgaggcaaggggctgggagtgggtgcaattatatcagaagataggaattgaaagacacgtaacggagactaccggagaacgggcccgtattcaccgtctccagacgacaacttccaaggaaacacactagcatctagactaaatacgtaacaactacaacaagtgaaggacacggactagttactatttaagtgtagacgtacgacgcccccgtacgaacgccggtcccgcttacgacctacggg

SEQ ID NO: 375772 - DNA, 573 bp, Homo sapiens
  misc_feature: GZ8MTXP02G73UU.44.9.A09.1.454.CMB.2.raw
  modified_base (246)..(246): a, c, t, g, unknown or other
  modified_base (317)..(317): a, c, t, g, unknown or other
  modified_base (324)..(324): a, c, t, g, unknown or other
  modified_base (340)..(340): a, c, t, g, unknown or other
  modified_base (356)..(356): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgtggatattgtggtgacccagactccactctctctgtctgtcacccctggacagtcggcctccatctcctgcacgtctgatcggagcctctacatactaatggaanacttatttgtattggtacctacagagccaggccagtcgccgcagctccagtccagcaaggttccagccgtntttccgnggatgtcagacagggntcagtggcctcggctnagaaacagattcacactgacaatcacgccgcgtggaggcgtggcggagtcgtcgttggttcgtttacgtttacgtagtcgtttcgtaccgtaaagttacgtttaacggtaaccggttaccgtaccgtttttacgggacccggtacgggggtaaccccggtcggttacgggaacgggttacgtaaacgtacggtaaaccgttcggtacggtacgtcgg

SEQ ID NO: 375773 - DNA, 598 bp, Homo sapiens
  misc_feature: GZ8MTXP02GXA6K.44.9.A09.1.454.CMB.2.raw
  modified_base (225)..(225): a, c, t, g, unknown or other
  modified_base (290)..(290): a, c, t, g, unknown or other
  modified_base (321)..(321): a, c, t, g, unknown or other
  modified_base (330)..(330): a, c, t, g, unknown or other
  modified_base (350)..(350): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcaccctggacagtcggcctccatctcctgcacgtctgatcggancctcttacatactaatgggaatactttatttgtattggtacctacagagccaggccagtcgccgnagctcctagtcccagcaaggttccagccgtnttttcccgnggtagtcgtcagacgagggntcgaggtcggcctccggctacaagaaacagtacttacacactagaacactacacgccgacgtcgggaggcgtaggcggtatcggtcgttggttagttttattacgttggtcgttggtacgtaacgtcgttttaacggtaccggtttacttaccggtttttcgggacccgggtaccgggggtaccccggtacggttacggggtaacggttacgtaacggttaccggaacgttcggtcgggtacgttcgg

SEQ ID NO: 375774 - DNA, 533 bp, Homo sapiens
  misc_feature: GZ8MTXP02JUT55.44.9.A09.1.454.CMB.2.raw
  modified_base (295)..(295): a, c, t, g, unknown or other
  modified_base (348)..(348): a, c, t, g, unknown or other
  modified_base (405)..(405): a, c, t, g, unknown or other
  modified_base (443)..(443): a, c, t, g, unknown or other
  modified_base (517)..(517): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctcgtggattcatcttcaggacctatgccatgcacgtgggtcccnccaggcctccgaggcaaggggctgggagtgggtgactaattatatccagaagntaggaattagaaagacacgtacgggagacgtcgaaggaaacgggccattcaccgtcncagagacaactcaaggaacacactgcatctagacaatntaacaacctacaacgagtgaggacacggctcgtatattattgcgacgagaccgccccgtcgaacgccggtcccncgttacgactaccggg

SEQ ID NO: 375775 - DNA, 652 bp, Homo sapiens
  misc_feature: GZ8MTXP02JQI4L.44.9.A09.1.454.CMB.2.raw
  modified_base (295)..(295): a, c, t, g, unknown or other
  modified_base (329)..(329): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctcctgagactctcctgtgcagcctctggattcatcttcaggacctatcgccatgcacgtgggtcccncgaggctccgaggcgaaggggctgggagtggggngactaattagtataccgaagaagtataggggaattaggaaaacgtacgaacgtaacgggaacgtaaccgtccgggaaagggaaacgggtcccgtaacgtttccgaaaccccggttcctacccgaaggaacgaaacctaaacgttacccgaaacgggaaaccaccgaacgtacgacctaatccgtacgaactaaaactcgtaaaccaaccctacaaacgaagacggaacggacgacggtacttacgttacttaacgttagttacgtcgacgacgaccgtcccccgagaccggtacccggtcccgtacgttacgaccgtaccggg

SEQ ID NO: 375776 - DNA, 784 bp, Homo sapiens
  misc_feature: GZ8MTXP02GIPQC.44.9.A09.1.454.CMB.2.raw
  modified_base (294)..(294): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcgacccagcctgggaactccctgagactctcctgtgcagcctctggattcatcttcaggacctatgccatgcacgtgggtcccnccaggctccgaggcaaggggctggggagtggggtgactaagttatataccgaagaagtagtagggaaatttaggaaaacgacgaacgtaacggggaaacgtaccgttacccgggaaagggtaaacgggggacccgtaacgttacccgtaaaccccggttccgtaacccgaaggaaacggtaaaccaaacgtttacccgaaaacgggaaaacccaaaccgaaccgttacggaactaacgttaccgttaacggaaccgtaaaaacttaccggttaaaacccaaaacccgttaaccaaaaccgtaaaagggttaacggaaacggggtaaacccgaaccggggtacctttaacgggtttacctttaaacgttttaaagtttcgggtttacgggtaaccggaacggtaacccggtaaccccccggttacgggaacccgggttaaccccggggttcccccgtaccgtttaccgggtaacccgtttaaccccggggg

SEQ ID NO: 375777 - DNA, 683 bp, Homo sapiens
  misc_feature: GZ8MTXP02I8YOW.44.9.A09.1.454.CMB.2.raw
  modified_base (293)..(293): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatctcaggacctatgccatgcacgtgggtcccncaggcctccgaggcgaaggggctgggaggtggggtggactaattactatccgaagaagagtaggaattagaacgaccactaacgggagtacgtaccggaagaacggggccgattccgacccgtctaccgaaggacgaacaacgttacccgaaggaaaccaccgtacgtacgacctaacttccgtacgaactaaacgttacgtaaacccaaacccgttacaaaccgtaaaggttacggaaacgggaacccgaacggtaccgttacggtttaccgttaatttaaacgtttcggtacggtaccggtaacggtaacccggtccccccgttaacgggaaccgggttacccccgggtacccccggtacgtttaccggtaacccggtttacccgggg

SEQ ID NO: 375778 - DNA, 504 bp, Homo sapiens
  misc_feature: GZ8MTXP02GG09Z.44.9.A09.1.454.CMB.2.raw
  modified_base (225)..(225): a, c, t, g, unknown or other
  modified_base (247)..(247): a, c, t, g, unknown or other
  modified_base (329)..(329): a, c, t, g, unknown or other
  modified_base (345)..(345): a, c, t, g, unknown or other
  modified_base (430)..(430): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcaccctggacagtcggcctccatctcctgcacgtctgatcggancctcttacatactaatgggaanacttatttgtattggtacctacagaggccaggccagtcgccgcagctcctagtcccagcaaaggttccagccgtcttttccnggactgtcagacaggntcagtggctccggctcgaagaaacagtattcacactagaacatcacgcgcgtggagctgcgatgcgtgtgtttatactgacttgntagtctttacgacgtactacgtttcggacggacgggaccgcgtaggaacgtacgaagtcgaagtcgtcggctcg

SEQ ID NO: 375779 - DNA, 544 bp, Homo sapiens
  misc_feature: GZ8MTXP02J0S4N.44.9.A09.1.454.CMB.2.raw
  modified_base (253)..(253): a, c, t, g, unknown or other
  modified_base (294)..(294): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctntggattcatcttcaggacctatgccatgcactggggtcccnccgaggcctccgaggccaagggggctggggagtggggtggactaattactatccagaagatagggaattgaaagacacgtaacggagacgtccgaaggaacgggccgattccgaccgtctaccgagagacaattccgaaggaacacactgcatctgacaaatgtaacaacctacaacaagtagagacacggctagtctattatgtcgacgagacgccccgtcgacgaccggtcccgcttacgactaccgg

SEQ ID NO: 375780 - DNA, 611 bp, Homo sapiens
  misc_feature: GZ8MTXP02IMCHW.44.9.A09.1.454.CMB.2.raw
  modified_base (297)..(297): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggaggagcggccagcctgggaactccctgagctctcctgtgcagcctctggattcatcttcaggacctatcgccatcgcaccgtgggtcccncaggcctccgaggccgaaggggctagggaggttggggtggactaattaataagtaaagaagtataggaattgaaaaggaaccaggtaccgggaagtaccgtaccgaagggaacggggccattaccgaccgtctaccgagaacgactaacttccgaagaacacaactgacctactctagacaaatcgtaaaccaacctacaacgaagtaggacgaacgacgctagtacttagttacgttgtacgtcgaacggtccgcccccgtaacggtacggtacccggtccccgtaccgttcggaacgttccggtaccggggg

SEQ ID NO: 375781 - DNA, 555 bp, Homo sapiens
  misc_feature: GZ8MTXP02JH0ZR.44.9.A09.1.454.CMB.2.raw
  modified_base (226)..(226): a, c, t, g, unknown or other
  modified_base (248)..(248): a, c, t, g, unknown or other
  modified_base (289)..(289): a, c, t, g, unknown or other
  modified_base (325)..(325): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcaccctggacagtccggcctccatctcctgcacgtctgatcggancctcttacatactaatgggaanacttatttgattggtacctacagagccaggccagtcgccgnagcctctagtccagcaaggtccagccgtcttttccnggtagtgtacagaccagggactcgaggttcggcctccgggctacaagaaacagtattacactactagacaatcgacgtccgcgtggaggcgtggcggtagtgtcgttggtagtttattacgtgtcttgacgtaagtcgtttaacggtacccgttacgtaccgtttcggaccggtacgggggacccggtcgtacgggtaacgtacgtaacgtcgaacgtggtacgtcgtcg

SEQ ID NO: 375782 - DNA, 687 bp, Homo sapiens
  misc_feature: GZ8MTXP02JKN56.44.9.A09.1.454.CMB.2.raw
  modified_base (295)..(295): a, c, t, g, unknown or other
  modified_base (349)..(349): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtctgggggagagcggcccagcctgggaactccctgagactctcctgtgcagcctctggattcatcttcaggtacctatgccatgctacgtcgggccnccgaggcctccgaggacgaaggggtctggggaggtggggtagactaaattatanaccgaaggaagagtaggggtaattaggaaacgaccgtaacgtacgggaataccgtaccggaaagggaccgggaccgtattacccgaacccgtaccgtacgaagaacgtaacaacttacccgaaaggaaacccacgaaccgtacgacctaactccgtagactaaacgtacgtaaaccctaacctaccgaaacgtaaaggtacggaaacggaaacccgacgggtaccttaggttaaccgtttaactttacggttagggtacgtaccgggaacgtaccccggcccccgtaacggggaacccgtaccccggtcccgtaccgttacgaacccgtttaccgggg

SEQ ID NO: 375783 - DNA, 609 bp, Homo sapiens
  misc_feature: GZ8MTXP02F2GRT.44.9.A09.1.454.CMB.2.raw
  modified_base (256)..(256): a, c, t, g, unknown or other
  modified_base (298)..(298): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctgnggattcattcttcaggacctatgccatcgcacgtgggtcccncaggcctcgaggcaaggggctgggagtggggtgactaattatatccgaagaagtagtagggtaaattaggaaacgaccgacgtaacgggaagaccgtaccgggaaaggaaacggggcccgtaacgttcccgaacccgtccgtacccgaaggaacgaacaacttaccgaaggaaccacacgtagaccatctgaactaaacgtacgtaaaccaacctacaacgtaacgtcggaacgacgacggtctagtacttagtattgtcgacgacgaccgccccgtcgacgtacccggtcccgtcgtacgacgtaccggg

SEQ ID NO: 375784 - DNA, 615 bp, Homo sapiens
  misc_feature: GZ8MTXP02HG8G2.44.9.A09.1.454.CMB.2.raw
  modified_base (298)..(298): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatcgccatcgcacgtcgggtcccncaggcctccgaggcgaaggggctggggaggtgggtgactaaattactataccgaagaagtagtaggaaacttagaaagacacgtaacggaacgaccgtaccggaaggaacgggccgtaacgttccacccgttcctaccgaagtacgaactaacgttaccgaaggaaaccacactacgactagtctagactaaagttcgaaaccacctacaacgtaaggtagaacggacgacggtctaggttacttagttattggtacgacgtacgacccgccccgtacggaccgtacccgggtccctcgttaccgtaccgtaccggg

SEQ ID NO: 375785 - DNA, 694 bp, Homo sapiens
  misc_feature: GZ8MTXP02FLEEY.44.9.A09.1.454.CMB.2.raw
  modified_base (253)..(253): a, c, t, g, unknown or other
  modified_base (296)..(296): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggaggagcggccccagcctgggaactccctgagactctcctgtgcagcctntggattcatcttcaggccctatgccatgccacgtggggtcccnccagggcctccgaggccgaaaggggtctgggaggtggggttcggactaaactttagtaactcccgaaggaaacgagttagggaaattggaaacgtaccaaccgtaacgggacgaccgtaccgaaggaaacgggtcccgtaacgttaccgaacccgtacctacccgaagaacgaaccaaacgttacccgaaacggaaaccaaccgaccgtcggacctactcctacgacctaaaacttacgtaaacccaaccctaaccaaaccgtaaacgtacggaacgggaaccgtaaccgggtacttacggttacttaacttaacgttcggtacgtaccgacggacccgccccccgttacggaccggtaccccgggtcccccgtacgttacgtacccgtaacccgggg

SEQ ID NO: 375786 - DNA, 624 bp, Homo sapiens
  misc_feature: GZ8MTXP02HY41Y.44.9.A09.1.454.CMB.2.raw
  modified_base (292)..(292): a, c, t, g, unknown or other
  modified_base (339)..(339): a, c, t, g, unknown or other
  modified_base (392)..(392): a, c, t, g, unknown or other
  modified_base (428)..(428): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggccagcctgggaactcctgagactctcctgtgcagcctctggattcatctcagacctatcgcatgcagtcgggcccncaggcctacgaggcgaaggggctgggaggttgggtagactaaagttntatccgaagtaaacgtagtacgggtaattaggaaacgacgtacgtaacggaanacccgtacgggaaggaacggccgtatccgacccgtnaccgagaacgaactactcgaaagaacacactagcagttcagaactaaatacgtaaccaacctacgaacgaaggtcgaaacgggactacgggtactagttacctttaacgttagttacggtacgaacgacggtaaccccgcccccgttagggaccgttaacccccggtcccgtacgtttacggaaacccgtccgggg

SEQ ID NO: 375787 - DNA, 683 bp, Homo sapiens
  misc_feature: GZ8MTXP02I5PSO.44.9.A09.1.454.CMB.2.raw
  modified_base (210)..(210): a, c, t, g, unknown or other
  modified_base (308)..(308): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagngcggcccagccgtgggaacctccctgagactctcctgtgcagcctgtggattcatcttcgaggtacctatcgcctagtcgcctacgtcggggtccccnccgaggcctaccgaggccgaagggggctggggaggtggggtggactaattatatccgaaggtaagagtaggtaattaggaaacgacgtacgtaacgggaacgtaccgtaccgggaaagggaaccggggtacccgtacttacccgacccgttaccgtacccgaagaacgaacctaacgttaccgaacggaaaccacgaacgtcgactatacgtagaactaaacgttacgaacccaacctacaaaccgtaaaggtacggaacggaccgtaccggtacttacgtttacttagtttaacgttggttcggaccgtacggacccgtaacccccgtaggaccggtacccggtccccgtcgttaccggaacccgttaccgggg

SEQ ID NO: 375788 - DNA, 575 bp, Homo sapiens
  misc_feature: GZ8MTXP02GNK28.44.9.A09.1.454.CMB.2.raw
  modified_base (224)..(224): a, c, t, g, unknown or other
  modified_base (326)..(326): a, c, t, g, unknown or other
  modified_base (342)..(342): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcaccctggacagtcgcctccatctcctgcacgtctgatcggancctcttacatactaagtggaatacttattgtattcggtactacagacggccagccagtcgccgcagctcctagtccagcaacggttccagccgtctttccgnggtatgtcagacaggntcgagtcgctccgctacgaagaaacagtacttcacgactagacatcacgccgtcgtaggacggcgtggcggtatcggtcgttggtttgtttaacttacgtcgttctttagacgtaacgtacgtttaacgtacccggttactttaccgttttcgggaccggtaccgggggtacccgtcggtacgggtaacggttaacgaacgttaccggtaaacgttggtacggtacgttccgg

SEQ ID NO: 375789 - DNA, 612 bp, Homo sapiens
  misc_feature: GZ8MTXP02JL600.44.9.A09.1.454.CMB.2.raw
  modified_base (297)..(297): a, c, t, g, unknown or other
  modified_base (333)..(333): a, c, t, g, unknown or other
  modified_base (345)..(345): a, c, t, g, unknown or other
tcagacagtatatacacgaccggtgctcgatttagcgagacgcgcaggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagcgacccagcctgggaacctcctgagactctcctgtgcagcctctggattcatcttcaggcctatcgccatgccacgtcggggtccncgaggcctccgaggcgaaggggctggggacgtgggnggactaaagttntataccgagaagatagggaattgaaacgacacgtacgggacaccgtacgaggtacgggccgtatccgaccgtctaccgaagtacgactaacttaccgaaggaaccacgactagctaactctagacaaagtacgtaaccaacctacaacgtaagtacggaacgaccgacggtacctagttacttaacgttagttcggacgtacggaacgtaccgaacccccgttcgaacggtccccggtacccgtcgtttaccgacgttaacccgggg

SEQ ID NO: 375790 - DNA, 564 bp, Homo sapiens
  misc_feature: GZ8MTXP02IJST1.44.9.A09.1.454.CMB.2.raw
  modified_base (297)..(297): a, c, t, g, unknown or other
  modified_base (343)..(343): a, c, t, g, unknown or other
  modified_base (402)..(402): a, c, t, g, unknown or other
  modified_base (407)..(407): a, c, t, g, unknown or other
tcagacagtatatacacgaccggtgctcgatttagcgagacgcgcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggccagcctgggaactccctgagactctcctgtgcagcctctggattcatcttcaggacctatgcccatgccacgtggggtcccnccaggcctccgaggcgaaggggcctgggaggtggggtgacaattanatccaagagataggaattgaaagacactacggagacctccggagagggccatcacctcncaganacatcagaacacactgacatctagacaaatcgtaaccaacctacaacgaaagtggaacggacgacggtacgttacggtacttattaaacgttgtacgacgtaccgaccgtcccccgtacggacgcccggtaccccgacgttacgaccgttaaccggg

SEQ ID NO: 375791 - DNA, 677 bp, Homo sapiens
  misc_feature: GZ8MTXP02JDH58.44.9.A09.1.454.CMB.2.raw
tcagacagtatatacacgaccggtgctcgatttagcgagacgcgcagggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagcggccagcctgggaactcccgtgagactctcctgtgcagcctcgtggattcatcttcagtacctatgccatcgcacgttgggccccacaggcctacgaggccgaaggggctaggggaggtggggcggactaagttacgtataccgaagtaaagagtaggtaaattaggaaacgaccgaacgttaacggaagaccgtaccgggaaaggaaacggggcccgtaattaccgaacccgttccgtaacccgaagtaaccggaactaaaccgttaccgaaacggaaacccacgtaacgtacacagttacacgaactaaagttcaaacctacctaacaaccgtaaaggtacgaacgggaacaccgggtacgttgttaccgttaaagtttaacgttggtacgacggtacgtacccgtaacccccgtacggaacgtaccccgggtccccgtactttaccggaacttacccgggg

SEQ ID NO: 375792 - DNA, 647 bp, Homo sapiens
  misc_feature: GZ8MTXP02GWBOJ.44.9.A09.1.454.CMB.2.raw
  modified_base (193)..(193): a, c, t, g, unknown or other
  modified_base (216)..(216): a, c, t, g, unknown or other
  modified_base (225)..(225): a, c, t, g, unknown or other
  modified_base (270)..(270): a, c, t, g, unknown or other
  modified_base (293)..(293): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtccaccctggacngtcggcctcatctcctgcacgtntgatcggancctctacataactaagtgggaatacttatttgtattggtacctanagagccaggccagtcgccgcacnctcctagtcccagtccaaaggttcccacgtccgttcttttcccgtgggtacgtgtaccaaggtaaccaagggtactcgtaaggtccgggccttcccggggactacgaaacgaaaacctagtaaactttccaaactacgtacgaaactaactacgaaccggccccgtaggtcggggaacggccgtagggaccgggtagtggtaccggttgggttagttttacgttaccttggtcttgacgtagtacgtttacggaccgtttaccgttaccggtttcgggacccggtacgggggtacccggtcgttacggggaacggtactaaacggttacggtaaacgttggtcgggtactccgg

SEQ ID NO: 375793 - DNA, 563 bp, Homo sapiens
  misc_feature: GZ8MTXP02IRZXV.44.9.A09.1.454.CMB.2.raw
  modified_base (217)..(217): a, c, t, g, unknown or other
  modified_base (225)..(225): a, c, t, g, unknown or other
  modified_base (287)..(287): a, c, t, g, unknown or other
  modified_base (334)..(334): a, c, t, g, unknown or other
  modified_base (375)..(375): a, c, t, g, unknown or other
  modified_base (392)..(392): a, c, t, g, unknown or other
  modified_base (394)..(394): a, c, t, g, unknown or other
tcagacagtatatacacgaccggtgctcgatttagcgagacgcgcagggggactgaccaggacttctcagttcatcttctcaccatgaggctccctgctcagctcctggggctgctaatgctctggatccctggattgagtgcggatattgtggtgacccagactccactctctctgtctgtccaccctggacagtcgcctcatctcctgcacgtcngatcggancctcttaacatactaatggaactattattgtattggtacctacagagccaggcagtcgccgnagctcagtaccaaataacggttccagtcgactttttcgacggtagtntacgaagacaggtatcgagtgcctccgactacaagaaaacnttactacacactagaananacacgcgacgtaggagacgtgacgtagtgtgttagttagtttagttacgttagtagtacgtacgtacgtacgttaacgtaacggtacgttacgttacggtaccggtaccgggtaccggtacggtacggtacgtaacgtaacgtacgtacgtacgtacgtacgtacgacg

SEQ ID NO: 375794 - DNA, 589 bp, Homo sapiens
  misc_feature: GZ8MTXP02HRTNI.44.9.A09.1.454.CMB.2.raw
  modified_base (297)..(297): a, c, t, g, unknown or other
  modified_base (327)..(327): a, c, t, g, unknown or other
  modified_base (344)..(344): a, c, t, g, unknown or other
  modified_base (427)..(427): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccactctctctgtctgtcaccctggacagtcgcctcatctctgcacgtctgatcggacgccttcttacatactaaagtgggaatacttatttgtattggtacctacagacggccaggccagtcgcgcagctcngtccagcaaggttccagccgtcttttccgnggagtgtcagacaaggntacgaggtcggccttccgggctacgaaagaaaacctagtacttcacgtacctagaacaactcgacgccgcggtaggaggtcgnggaccggtagtcgacggtttgttagttttaacgtagttcgtcgttgaacgtaacgttacgtttaaccggaccgtttacgttacgtttcgggaccggtaaccgggggtcccggtacgtagggaacggttacaaacggttccggtaacgtggtacggtcgtcgg

SEQ ID NO: 375795 - DNA, 718 bp, Homo sapiens
  misc_feature: GZ8MTXP02JZ2BO.44.9.A09.1.454.CMB.2.raw
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggattattgtggtgacccagacctccactctctctgtctcgtccacccgtggacacgtccggcctccatcctcctgctacgtctgacgtcggacgtccttacttaacaactaacgtaagtaggtaagtactttaagtttagtagtttacgtaacctacgtaggacgccgacggcctacgtccgccgcgacgtcctaccgacgtaccgacggtacgtaacggttccacgtccgttcgtttcgtaggtagtcgtacgagacgtagtactcgaggtcgtccgtccgctaacaagaaactagtacttacaactactacgaacacgtcgacggtccgacggtaggacggtcgtcggtacgggtagttcggtcggtttaggtttagttttacggttaacgtcgtttcgttaagaccggttaaaacgtttaccggtttaaaccgggtacccggtttaaacgtttaccgggtttaccgggaaaccccggggttccgggggtaaccccggtcgggtttaacgggaaacggtttaacccgtaaacggttaccggttaaacggtcggggttacgtaccggtaacccg

SEQ ID NO: 375796 - DNA, 632 bp, Homo sapiens
  misc_feature: GZ8MTXP02G731B.44.9.A09.1.454.CMB.2.raw
  modified_base (273)..(273): a, c, t, g, unknown or other
  modified_base (293)..(293): a, c, t, g, unknown or other
  modified_base (324)..(324): a, c, t, g, unknown or other
  modified_base (330)..(330): a, c, t, g, unknown or other
tcagacagtatatacacgaccggtgctcgatttagcgagacgcgcaggggactgaccaggacttctcagttcatcttctcaccatgaggctccctgctcagctcctggggctgctaatgctctggatccctggattgagtgcggatattgtggtgacccagactccatctctctgtctgtccacccctggacagtcgcctccatctcctgcacgtctgatcggagtccctcttaccataacgtaatgggaatacttattgtatttggacctanagagccaggccagtcgccgnagctctacgccagctaacggtccagtccgtntttccnggtagtgcagaacagggactccaggtcggccgtcccggataccaaagtaaacgagtaactttaccaactaacgtacgaataactaccgaacggcccgtcggtacggggacggtccgtagggacggtagttcgggtccgtttagggtttcgtttaacgtttacgtggtacgttgtaccgtaaagttaccgtttaaaccggtacccgggttacgttaccggttttacggacccgggtaacgggggacccccgtaggtacgggtaacggtactaaacggtccgtaagtcggtacgggtctaccgg

SEQ ID NO: 375797 - DNA, 529 bp, Homo sapiens
  misc_feature: GZ8MTXP01B9TML.2.21.B10.1.454.CMB.2.raw
  modified_base (316)..(316): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctataggtaaaacaccggcctnaggactccagaccgacttctctggctcctaactcaaggaaacacagctccttgaccatcactggggctcgaggcggaaagatgaggctagacttattattgggtaagtcggggacagaagtgtaattcagtggtgttcggcgggtaagggaaccaagcgtcgaccgtcctacgttcgagcccaaggctcgcccctggttcaaccgttcgtccg

SEQ ID NO: 375798 - DNA, 729 bp, Homo sapiens
  misc_feature: GZ8MTXP01B92RQ.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgacaagtggtaccagcagaagccaggacaggcccctgtaattgtcatctatggaatctataggtaaaacaccggccctacgagggacctaccgacgaccgtactcctcgtcgtcctactaactacgaacgaaacacgacttccttaccgtacaactactacctacgggtcgggtccacggagggaaccgggaagtaggtaggtacggtacgtacgtaacgtttaagtttaaggtttaacgggggttaaccggggttaacccgggggaaacgtaaacggggttaaacggttaaacggtttaaacgttaacgttacggggtttagggttaccggggttacggggaacggggtaaacccgggaaacggtaaacgggttccgtaacccgggttacccggttaaccggtacccgttaaccgaccggaacccggtaaccgtccccggtccccgttcccccgggtcggttaacccctcccgttcccgttttccccccg

SEQ ID NO: 375799 - DNA, 566 bp, Homo sapiens
  misc_feature: GZ8MTXP01CEM1G.2.21.B10.1.454.CMB.2.raw
  modified_base (338)..(338): a, c, t, g, unknown or other
  modified_base (406)..(406): a, c, t, g, unknown or other
  modified_base (451)..(451): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaacctatatgcaagttgtaccagcagaagccaggacaggccctgtaattgcatctatggaatctataggtaaaaacaccggccctcaggactcccagaccgacttcctntcggctcctaaactcaaggaaacacacgtccttccttgaccatccacgtggggctcgaggcggaaagngtggaggctagaacttattagttaggggtaaacgtcccggggaanaagggtaaagtggttaaattacgagtgggtagttcgggacggagggaaccaagcgtgacccgttctacgttcgacgcccaaggcctcggccccctggttccaaccgttcgtcccg

SEQ ID NO: 375800 - DNA, 669 bp, Homo sapiens
  misc_feature: GZ8MTXP01A2T29.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaacctattatgacaagttgacagcagagcagacacgccctagtaatgtcatctatggaatctatagtaaaaccaccggccctacgaggactacccgagaccgtacttcctcgtcggtcctcctaaactacgaacggaaaccacacgtcctttacctcgaacctatcctaacgtcggggcctacggaagggacggaaagtacgtaggaacggtctagtaacttagtttacgttagggggtaacgggtaccggggtaacaagggtaaaggttaggttaaaacttagtaggttgggttacgggttaccgggacgggaacggggtaaccgtaaaggttccggtacggttaccccggttaccgtaaccgttaccgaaccggaccccgaaacgggtccctcccgtcccccggtacggttaccctaacccgttccgtttaacccccg

SEQ ID NO: 375801 - DNA, 641 bp, Homo sapiens
  misc_feature: GZ8MTXP01B5UAI.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctatatgcaagttggtaccagcagaagccaggacaggcccctgtaattgtcatctatggaatctataggtaaaaccaccggcctacgaggacctacgacgactacttctcgtcgtcctacctaacacgaacgaaacacgacgtccttcgtacgacactaccgtacggtcgggtactacggacgggaacggaagtacgtagggacggtacgtacgtaacttaagtttacggttaacggggttaaccggggtaaccgggtaacgtaaagggtaaggttaagttaaacgttacgtaggttggttacgggtcgggacggggtaacggaacgtacgttacggtacgaccgtaccgtcgttaccgaccgaccgaacgtccgtcccgcccgtcgttacctaaccgttccgttccccg

SEQ ID NO: 375802 - DNA, 713 bp, Homo sapiens
  misc_feature: GZ8MTXP01C0LI3.2.21.B10.1.454.CMB.2.raw
  modified_base (218)..(218): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcagaacctattatgacaagttggtaccagcagaagcaggacacggccctgtaatgtcatctatggaatctaatacggtaaaacacccggccctacgagggactcccgagaacccgtacttcctctggcctcccgtaaactcgaacggtaaaccactacgtccttaccgtacgaacccattaccaacgttcggggacctcggaacgggacgggaaagagtcggaaggtctagaacttaagtttacgttagggggttaaacggggttacccgggggaataagggtaaaggttaggttaaactttacggtaaggttgggggttacggtttacgggggaccgggggaaaggggtaaccccgtaaagggcccggttaacgggaccccggttacccgttaaccgggttaccgaccgggaccccgtaaacggggcccgtttaacccgggccccccccgttacggggttccctaacccggttcccgtttccccggg

SEQ ID NO: 375803 - DNA, 527 bp, Homo sapiens
  misc_feature: GZ8MTXP01CM8LP.2.21.B10.1.454.CMB.2.raw
  modified_base (497)..(497): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctataggtaaaaacaccggccctcagggactcccagaccgattctctggctcctaactcaaggaaacacagcttcctgaccatcacgtggggctcgaggcggaaagagtgaggctagactattagttggtaagtccggggacagaagtgtaattacagtggtgtcggcggagggaaccaagctgccgtcgtcgttgcccccgnaaggctcgcccctcggctaacgttcgtccg

SEQ ID NO: 375804 - DNA, 532 bp, Homo sapiens
  misc_feature: GZ8MTXP01BKU6R.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctaataggtaaaaacacccggccctcagggactcccagaccgattctctggctcctaactcaaggaaacacagcttccttgaccatcacgtggggctcgaggcggaagagtgaggctgactattagtgggtaagtccggggacagaagtgtaatcagtggtgtcggcggagggaaccaagcgtgaccgtctacgttcgcgcccgaagctcgcccccgtggttccaaccgttcgtcccg

SEQ ID NO: 375805 - DNA, 774 bp, Homo sapiens
  misc_feature: GZ8MTXP01D47WT.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaaggagacagcctacaagtaaccttattatgacaagttcggtaccagacagaacgcaggacacggccctagtaattgcatctatggaatactaataacgtaaaacacccggcctacgaggactaccagaccgtacttctacgtcggccttaccgtaaacctacgaacggtaaacaacgtacgttaccttccgttacgaaccctataccgacggtacgggggtacctaccggaagggaccgggtaaagtacggttaggaacggtaccgttaaggtaacctttaagtttaaggtttaacgggggttaaaaccggggtttaccccgggggaaacgtaaacgggttaaacggtttaacgggttaaagtttaaccggtaaggtttggggttacgggtttaccgggggaacggggaaacggggtaaaccgtaaacgggttcggttaacccggttaacccggttacccgtaaccggttaccgaacccggttaccccggaacgggtcccgttccccgggtacccccccgttcgggttaccctaaccccgtttcccgttttccccccg

SEQ ID NO: 375806 - DNA, 598 bp, Homo sapiens
  misc_feature: GZ8MTXP01EBU27.2.21.B10.1.454.CMB.2.raw
  modified_base (217)..(217): a, c, t, g, unknown or other
  modified_base (419)..(419): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggngacagcctacagaacctattatgacaagttggtaccagacagaagcaggacaggcccctgtaattgcatctatggaatctaataggtaaaaacaccggccctacgaggactacccgagaccgtacttctactggtcctaccgtaactacaaggaaacacagtccttaccttacgactatacacgtgggctagaggtcgaagntgaggctagactagttagttaggggtaacggtccggggaaatagggaaagttagggttaaattaacgtaaggttggttaggttcgggacggaagggtaacccaaaggccgtagaccgtctaacgttcgacgacccgtaaggccgtaacgccccctcggttacctaaccgttcgtccccg

SEQ ID NO: 375807 - DNA, 812 bp, Homo sapiens
  misc_feature: GZ8MTXP01EROP2.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaacctattatgacaagttgtaccagcagaacgccaggacacggcccctgtaattgtacatctatggaatctaatacggtaaaaacacccggcctacgaggactacccgagaccgtattcctacgtcggtacccttaccctaaaccttaccgaacgggaaaaccctaaaccgtaaccggttacccttttaccccgtttacggaaacccctaacgttcccgaaacggttcgggggccttacggaacggggtaccgggaaaaggtagttacgggacggggtaccttagtaacgttaaagttttaaggttacgggggtaaacggggttacccgggggaaacgtaaagggttaaaggttaagggttaaagtttaaccggtaaaggtttgggggttacgggtttaccgggggacgggggtaaacgggggaaccgtaaacgggttccggtaccgggttaaacccccggttcccggtttaaaccggggacccgttaacccgggttacccccggaaaggggtccccgttaacccgggtccccccccgttggggttaccccttaacccgtttcccggttttaacccccccg

SEQ ID NO: 375808 - DNA, 637 bp, Homo sapiens
  misc_feature: GZ8MTXP01AVV8R.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaacctattatgacaagttggtaccagcagaacgcagacagccctagtaatgtcatctatgaatctaatacggtaaaacaccgcctacgaggactcccgagaccgtacttcctcgtggcctaccctaaactacgaaggaaaccacacgtccttaccttacgaacctatcacgtcggggctacggaggacggaagagtggaggtctagtaacttattaacgttaggggtaacggtacggggtaacaagggtaaagttgttaaacttagtaggttgggtacggttccgggacgggtaacgggaaccgtaaggccgtacggttacccgttacccgtaacggttccgaccggacccgtaacgggcccttaacccggccccccgttggttaccctaaccgttccgtttccccg

SEQ ID NO: 375809 - DNA, 614 bp, Homo sapiens
  misc_feature: GZ8MTXP01ERC43.2.21.B10.1.454.CMB.2.raw
  modified_base (455)..(455): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctaataggtaaaacacccggcctacgaggactcccagaccgacttctctggctcctaactcaacggaaacacagtccttccttagacctatcacgtggggctcgagggcggaaagagtggagctagacttaattagttaggggtaacggtcccggggaanaggaaaggttaggtaaattacgaagttgggttggttacgggacgggtaacggggaaccaaaggttcgtacggttaccccgttccgtaacggttcgaccggaccccgaaagggtccctccggccccccgtcgggttacctaacccgtttccgttccccgg

SEQ ID NO: 375810 - DNA, 728 bp, Homo sapiens
  misc_feature: GZ8MTXP01D84L2.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtgccttgggacagacagtcaggatcacatgaccaaaggagacagcctacaagaaccttattatgactaagttggtaccagacagaacgccaaggacacggcccctagtaatgtcatctatggaatctaagtagtaaaaaccacccggaccctacgagggactacccgagaccgtacttctcgtcgtcctaccctaaactacgaacggaaaccacgtacgtccttacccgttacgaaccctataccgtacggttacggggacctacgaacggaccgaaaggaaacgtaagtaggaacggtacctaggtaacttaagtttaggttacggtaaacgggttaccggggaacgtaaaggtaagtagggttaaagttaaccgtagttaggggtacggtttaccgggacggggtaaacggggtaaccgttaaacgggtccgttaacgggtaaccccggttacccgttaacccgggttaccgaacccggtaaccccggaaacggtccccgttaccggacccccgttaaggttccccgggttaacccttaaccccgg

SEQ ID NO: 375811 - DNA, 644 bp, Homo sapiens
  misc_feature: GZ8MTXP01EEFQQ.2.21.B10.1.454.CMB.2.raw
  modified_base (265)..(265): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacaagaacctattatgacaagttggtaccagacagaanccaaggacaggccctagtaatgtcatctatgaatctaatacgtaaaaacaccggcctacgaggactaccagaccgtacttctctgcctacctaactacaacggaaacacacgtccttacctagacctactcacgtaggggcctacgaagggacggaaagagtaggacggtctagtaacttaagtttagttacggggtaaacgggttcccgggggaataaagggtaaagttaggttaaaatttaacgaagttgggttcggttacggggacgggaaacggggaacccaaagggttctacggaacccgttaccgtaacgttaccgacggaccccgtaagggccgtaaccgtcccccgtggacctaaccttcgtttaaccccg

SEQ ID NO: 375812 - DNA, 634 bp, Homo sapiens
  misc_feature: GZ8MTXP01ECTKZ.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgacaagtggacagcagaagcagacacggccctgtaatgcatctatgaatctaatacggtaaaacaccggcctacgaggactacccagaccgtacttctctggcctccctaaactcaaggaaaccacacgtccttcctacgaccatccacgtggggctacgaggacggaaagagtgaacggctagtaacttaagttagttaggggtaaacggttccgggggaaactaagggtaaaggttaggttaaacttacgtaaggttgggttcggttacgggacggggtaacggggaacccgtaaaggttccgtacggacccggttacctaaccggttaccgacggaccccgaacgggtcccgtcccgtcccccgtcggttaccctaaccgttcccgttccccg

SEQ ID NO: 375813 - DNA, 526 bp, Homo sapiens
  misc_feature: GZ8MTXP01APFJS.2.21.B10.1.454.CMB.2.raw
  modified_base (226)..(226): a, c, t, g, unknown or other
  modified_base (239)..(239): a, c, t, g, unknown or other
  modified_base (340)..(340): a, c, t, g, unknown or other
  modified_base (453)..(453): a, c, t, g, unknown or other
  modified_base (456)..(456): a, c, t, g, unknown or other
  modified_base (499)..(499): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnaagaacctattangcaagttggtaccagcagaagccaggacaggcccctgtaattgtcatctatggaatctaataggtaaaacaccggcctacgaggatcccagaccgacttcntgcctcctaactcaaggaaacacacgcttacctgaccatcacgtgggctcaggcgagatgagctgactattatggtaagtcggggtacagaagtgtaatacagtggtgtcggnggngggaaccaagctgaccgtcgacgttcgacgcccgaaggtcccnccgtccctcggttcctcgttccgtccg

SEQ ID NO: 375814 - DNA, 636 bp, Homo sapiens
  misc_feature: GZ8MTXP01BB5IH.2.21.B10.1.454.CMB.2.raw
  modified_base (561)..(561): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagccctacaagtaacccttattagtgacgtaaggttcggtaaccagacaagaacgccgagacacgccctagtaattgtcatctagtaggaatacgtaagtaacggtaaaaaccacccggtaccctacgaacgggtactacccgaacggtaccgtaacttccgtacgtacggtaccctacccgtaaaccgtaccgaacggtaaaccaccgtacgtccctttaccttacgacctactaccgtacgtcggggtctacggagggacggaagagtgaggtctagattattagttacggggaacggtacggagtagtaagtagtaagtacgagtggtggtacggnggaacggaacagcgtcgacgtccgtacgacgcgaccgaacgtccgtccgcccgtcggttactccgttccgtcccg

SEQ ID NO: 375815 - DNA, 713 bp, Homo sapiens
  misc_feature: GZ8MTXP01BHXOE.2.21.B10.1.454.CMB.2.raw
  modified_base (220)..(220): a, c, t, g, unknown or other
  modified_base (240)..(240): a, c, t, g, unknown or other
  modified_base (353)..(353): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgccaagganacagcctcagaacctattangacaagttgtaccagcagaacgcgaggacacggccctgtaattgtcatctatggaatctaatacggtaaaaaccacccggacctacgacggactacccagaccgtacttctcncggctaccctaactacgaacggaaaccacgtacgtaccttaccgtacgaacctactacctacggttcggggacccgtacgaacggggaccggaaaaggtagtacgggaacgggtcgttaacgtacgttaaagtttaacggtttaacgggggtaaacggggtttaccccggggggaaactaaagggtaaaggttaaacggggttaaactttaaaccggaggtttagggggttacgggttaccgggggtacgggggtaaacgggaaccgtaaacggttcggtacgacccgttaccgtacgttaccgacgaccccgtaaggccctaaccgccccgtacgttcctaaccgttccgttaaccccg

SEQ ID NO: 375816 - DNA, 587 bp, Homo sapiens
  misc_feature: GZ8MTXP01AYDUY.2.21.B10.1.454.CMB.2.raw
  modified_base (258)..(258): a, c, t, g, unknown or other
  modified_base (389)..(389): a, c, t, g, unknown or other
  modified_base (431)..(431): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaacctatatgcaagttgaccagcagaancagacagccctgtaatgcatctatgatctatagaaaacaccggcctcgaggactcccagaccgacttctctgctcctaactcgaagaaacacagtcttctagacctatcacgtggggctcgaggacgaagngtagagctagtactattagttagggtaacggtccggggtaanaacggtaagttggtaaattacgtagttgggtgttacggggacggtagggaacccgtaaaggccgtacgggacccgttacccgtaacgttccgacggaccccgtaaggggccctccgggtaccccccgtcgggttaccctcccgttcgttcccccgg

SEQ ID NO: 375817 - DNA, 657 bp, Homo sapiens
  misc_feature: GZ8MTXP01C0C75.2.21.B10.1.454.CMB.2.raw
  modified_base (231)..(231): a, c, t, g, unknown or other
  modified_base (245)..(245): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgaccaaaggagacagccctanaagaaccttattangacaagttgtaccagcaagaagccaggacacggcccctagtaattgtcatctataggaatctaataaggtaaaaaccaccggccctacgaggactacccagaccgtacttcctctcggctccctaaactacaacggaaacacgacgtccttcctacgaaccatcacgtgggacctagacggacgaaagagtagacggtctagtaacttagtttaagttacggggtaaacgggtacccggggtaataaagggtaagttaaggtaaagttacgtaaaggttcgggttacgggtttacgggacgggtaacggggtaacaacggttccggtacgttaccccgttaccgtaacgttccgacgaccccgaaggtcctaacccggtcccccgtcggttaccctccgttccgtttccccg

SEQ ID NO: 375818 - DNA, 634 bp, Homo sapiens
  misc_feature: GZ8MTXP01EQ9OS.2.21.B10.1.454.CMB.2.raw
  modified_base (415)..(415): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaacctattatgacaagttggtaccagcagaagcaggacaggcccctgtaattgtcatctatggaatctaataggtaaaacacccgcctacaggactcccagaccgacttctctggctccctaactcaacggaaacacagtccttccttacgaccatacacgtaggggctacgaggacggaaagngtaggaggctagacttaagttagttaggggtaacggtacccgggggaataaggtaaaggttaggtaaagtttacgagttggggttgtttacggggcgggtaaacggggaaccctaaaggccgtacggttaacccggtccgtaaccggttccgacgttaccccgaaacggggtcctcccggtacccccgtcgggttaccctaaccgtttcccgttccccg

SEQ ID NO: 375819 - DNA, 809 bp, Homo sapiens
  misc_feature: GZ8MTXP01DCBBD.2.21.B10.1.454.CMB.2.raw
  modified_base (225)..(225): a, c, t, g, unknown or other
  modified_base (234)..(234): a, c, t, g, unknown or other
tcagacgctcgacacacgaccggtgctcgatttagtgtcgtcgcaagagggagggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcaacatgaccaaaggganacagcctanaagaaaccttattaatgactaaagttggtaccagcaagaagcaggacaggcccctagtaatgtcatctataggaatctaataggtaaaaaacaacccgggaccctacgacgggatacccgaagaaccgtacttctcgtggcctacctaaactacaacggaaaacacgaacgtcctttaccttacggaacctaacttacccgaacgttcgggggtacctaccggaaaggggaacccgggtaaaaggaagttagggaacggggacttacgggtaaaactttaagtttaaacgtttaaggggggtaaacgggtttaaccccggggggggaaaactaaagggtaaaaagggtttaacgggttaaaacgtttaacgtaaaacggttggggttacggggtttacggggtaaccgggggaaacggggtaaaaccccggaaaggttacccggttaaccgggttaaaccccgttacccgtttaaaccggttacccgaacggttacccccggtaaaacggggaccctttcccgggaaccccccccggtcgggttacccgtaaaccgttcccgttttaaccccccg

SEQ ID NO: 375820 - DNA, 555 bp, Homo sapiens
  misc_feature: GZ8MTXP01EUW72.2.21.B10.1.454.CMB.2.raw
  modified_base (226)..(226): a, c, t, g, unknown or other
  modified_base (450)..(450): a, c, t, g, unknown or other
  modified_base (467)..(467): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaacctattatgacaagttggtaccagcagaagccagacagccctgtaatgtcatctatggaatctaataggtaaaacacccggcctacgaggactcccagaccgacttctactggctcctaactcaaggaaacacagtcttacctgaccatcacgtggggctcgaggcggaaagagtagaggctagtaacttaattagttaggggtaacggtaccggggaanaagtaaagtgtaattanagtggtgtacggcggaaggaaccaagctacgaccgtctacgttacgcgaccgaaggctccgccccctggttacctaacgttcctcccg

SEQ ID NO: 375821 - DNA, 618 bp, Homo sapiens
  misc_feature: GZ8MTXP01D1ENL.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacaagaaccttattatgacaagttggtaccagcagaagccaggacaggcccctgtaattgtcatctataggaatctaataggtaaaacacccgccctacgaggactcccagaccgtacttctactgcctacctaactacaaggaaacacacgtccttcctagacctatcacgtgggctacgaggacggaaagagtagaggctagattaagttagttagggtaaacggtccggggaaagagtaaaggtagtaaagttacaaggtggtaggttacgggagggacgggaacctaaggcgtcgttaacccgtaccgtaacgttaccgacgaccccgaaacgggtccctcccgggtcccccgtcgggttaccctaacccgttccgtttcccccggg

SEQ ID NO: 375822 - DNA, 658 bp, Homo sapiens
  misc_feature: GZ8MTXP01DZ8FH.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagaacagcctacaagtaacctattatgacaagttggtaccagacaagaagccaggacacggcccctagtaattgcatctatggaatctaatacgtaaaacacccgccctacgacggactcccagaccgtacttctctcggtcctaccctaactacaaggaaacacacgtcttcctacgactatcacgtggggctcgagggacggaagagtagaggctagtacttaagtttacgttaggggttaaacgggtacccggggtaagtaaggtaaaggttaggtaaagtttacgtaaggttaggggttcgggtttacggggaccgggtaaggggaacccctaaagggttccgtacgggttacccgttacccggtaccgttacgaccggacccgtaacggcccgtaacccgtcccccgtacggttcctaacccgttccgtttccccg

SEQ ID NO: 375823 - DNA, 608 bp, Homo sapiens
  misc_feature: GZ8MTXP01CVKQ8.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacaagtaacctattatgactaaggttggtaccagcaagaacgccgaaggaccacggcccctagtaacttgtcatctagtggaatctaataaggtaaaacacccggcctacgaggactccagaccgtacttctctggcctcctaactcaacggaaacacacgtcttcctacgacctatcacgtgggctcgaggacgaagactgacggctagactagtttagtggggtaaacggtccggggtaacaggtaagttagtaaacgtttacgagttgggttacggttacggcgggtaagggaaccaaaggcttacgaccggttccgtacgttcgccgacccgtaacggcctccggaccccgtcgttaccgtaaccttccgttcccg

SEQ ID NO: 375824 - DNA, 607 bp, Homo sapiens
  misc_feature: GZ8MTXP01EFG7B.2.21.B10.1.454.CMB.2.raw
  modified_base (284)..(284): a, c, t, g, unknown or other
  modified_base (467)..(467): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgacaagttggtaccagcagaagccaggacaggcccctgtaatgtnatctatgaatctaataggtaaaacaccgcctagaggactccagaccgtacttactcgtcggcctacccgtaaacctcaacgggaaacacgacgtccttaccttagaccctatccagtcgggctcgaggcggaaagcgtgacggctacgacttaattagttaggggtaaacggtcccggggaanaaggtaagttaggttaattacgtagtgggttacggttcgggacgggtaaggggaacccaaggcctacggacccgtcgtaacgttcgacgcccgaaggtcctaaccgtcccccgtcggttactaacccgttcgtttccccg

SEQ ID NO: 375825 - DNA, 714 bp, Homo sapiens
  misc_feature: GZ8MTXP01D3ZQX.2.21.B10.1.454.CMB.2.raw
  modified_base (220)..(220): a, c, t, g, unknown or other
  modified_base (241)..(241): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctcaagaacctattangacaagttggtaccagcagaagccaggacacggccctgtaatgtcatctatggaatactaataggtaaaaacacccggccctacgacggactacccagaccgtacttcctcgtcggtcccttaccctaaaccttaccgaacgggtaaaaccaccgtaacggtcccttttaccccgttacggaacccctacgttacccgaacggttaccgggggccttacggaacggggaccggggtaaaaggtacgttagggacgggtaccttaggtaactttaagtttaacgtttagggggtaaacgggttcccgggggaaataaggtaaaggttagggttaaacttaacgtaggttaggggttcggttaccggggacgggtaacgggaacctaaaggccgtacggttacccgtaccgtacgttacgacggttacccgaaggtccctccggcccccgtcggttctaacccgttcgttccccg

SEQ ID NO: 375826 - DNA, 621 bp, Homo sapiens
  misc_feature: GZ8MTXP01DH158.2.21.B10.1.454.CMB.2.raw
  modified_base (239)..(239): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattangacaagttggtaccagcagaagccaggacacggccctgtaattgcatctatggaatctaatacggtaaaacacccggcctacgagggactcccagaccgtacttctctggcctcctaactacaaggaaacacagtcttacctagaccatcacgtcggggctcgaggacggaaagcgtaggaggctagacttaagttacgttaggggtaaacggtccgggggaactaaggtaagttagggtaaattacgtaaggttcgggttaggttacgggacgggtaagggtaacccgaaaggttcgtacggacccgttccgtaacgttccgacgaccccgaaggtcccgtccggtacccccgtggttaccctaaccgttccgtttccccg

SEQ ID NO: 375827 - DNA, 651 bp, Homo sapiens
  misc_feature: GZ8MTXP01DW408.2.21.B10.1.454.CMB.2.raw
  modified_base (248)..(248): a, c, t, g, unknown or other
  modified_base (491)..(491): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttggggacagacagtcaggatcacatgaccaaagggagacagcctacaacgtaacctattangacaagttggtaccagcagaacgcaggacacggccctgtaattgacatctataggaatactatacggtaaaaacacccggacctacgacggactacccagaccgtactctctcggctcctaactacaacggaacacgacgtccttccgtacgacctactccgacgttcggggactacgacggacggaaagctaggacgactagtacgttaattaagttacgggtaaacgggttcccggggaanaaggtaaaggttagtaaagttaacgagtttggtcggttacgggacgggagggtaacaacggcgtacggttaccgttaccgtaacggttaccgaacgccccggtaaaggtcccgttcccgccccccgttacgggttccctaaccgttcccgtttcccccgg

SEQ ID NO: 375828 - DNA, 520 bp, Homo sapiens
  misc_feature: GZ8MTXP01D8HK9.2.21.B10.1.454.CMB.2.raw
  modified_base (395)..(395): a, c, t, g, unknown or other
  modified_base (427)..(427): a, c, t, g, unknown or other
  modified_base (479)..(479): a, c, t, g, unknown or other
tcagacgctcgacacacgaccggtgctcgatttagtgtcgtcgcaagagggaggggctcagaagcagagttctgggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaagacaggccctgtaatgtcatctatgaatctaataggtaaaaacaccggccctacagggactcccagaccgtattctctaggcctcctaactcaaggaaacacagcttcctgacatcatgggctcaggcgaaagntcgaggctgactattattggtaagtcgggganagagtgtaatcatggtgtggcggaggaactaagcgtcgacgtcctacgttcncgacccaaggcctcgccccctggttcctaacgttccttccg

SEQ ID NO: 375829 - DNA, 703 bp, Homo sapiens
  misc_feature: GZ8MTXP01EHQ0X.2.21.B10.1.454.CMB.2.raw
  modified_base (244)..(244): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacaagtaacctattangacaagttcggtaccagcagaagccaggacacggcccctagtaatgtcatctatggaatctaagtacggtaaaaacacccggcctacgagggactcccaagaccgtacttcctacgtggtcctaccctaaactacaacggaaacacgacgtcctttacccgtacgaaccgtactaccgaacgttcgggggacctacggaacgggaccggaaaaggacgttagggacggtaccgttagtaacctttaagtttacggtttacgggggttaaaacgggttaccgggggaaacgtaaggtaaagggtttacggttaaaagtttaccgtaaaggtttggggtacggtttaccgggaccggggaaggggtaaacccgtaaaggttccgtacggttaacccgtccgtaacgttacgacgcccgtaagcccgtaaccgccccgtggacctaaccgttccgttccccg

SEQ ID NO: 375830 - DNA, 643 bp, Homo sapiens
  misc_feature: GZ8MTXP01CXA9T.2.21.B10.1.454.CMB.2.raw
  modified_base (242)..(242): a, c, t, g, unknown or other
  modified_base (590)..(590): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagaacctattangacaagttgtaaccagacagaagccaggacaggccctagtaatgtcatctatgaatctaatacggtaaaaacaccggccctcgaagggactacccgagaccgtacttcgtacgtggaccttccctaaacctcaacggaaaacctacgaacgtcctttaccttacgaacccattaccaacgtgggggacctacgacgggacggaaagtacgtgaaggcctagtaaccttagtttaagttaggggtaaacggtccggggaaataagtaaaggttaggtaaaactttgaaaggttggtggttacggggacgtaaggggaaccaaggctaggaccccgtacgttacgaccgnaccccgtaaggcctaaccgccccgtcggttacctaacccgttcgttaaccccg

SEQ ID NO: 375831 - DNA, 745 bp, Homo sapiens
  misc_feature: GZ8MTXP01DRQN2.2.21.B10.1.454.CMB.2.raw
  modified_base (231)..(231): a, c, t, g, unknown or other
  modified_base (246)..(246): a, c, t, g, unknown or other
  modified_base (467)..(467): a, c, t, g, unknown or other
  modified_base (479)..(479): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaaggagacagcctanaagtaaccttattangactaaggttcggtaccagacaagaacgccgaaggacacggcccctagtaaattgtaccatactaagtaggaaattacgttaaagtaaacggtaaaaaaaccgaaccccgggtaccctacggaacgggtacctaccccgaacggacccgtaactttcctacgtcggtaccctaccctaaactacgaacggaaaaccacacgtcctttacctacgacctacnccagtcgggacncgaacgggacggaaagagtggacggtctacgtaattaatttaaggttacggggttaaacgggttaccggggaaagtaaggtaaaggtaagttaaacgttacgtaggttgggtacgggttacgggacgggaagggtaaacccgaaggttacgtaacggttaaacccgttaccgtaaaccggttaccgaaccggaaccccgtaaccggtcccgtccccgggtacccccgttaccgggttacctaacccgtttcccgtttaaccccccg

SEQ ID NO: 375832 - DNA, 789 bp, Homo sapiens
  misc_feature: GZ8MTXP01DEX1Q.2.21.B10.1.454.CMB.2.raw
  modified_base (264)..(264): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacaagaacctattatgacaagttgtaccagcagaancagacacgccctagtaatgtcatctatggaatctaatacggtaaaaacaaccggaccctacgagggactacccgagacccgtaacttcctacgtggccctaccctaaaccttaccgaacgggaaaaccaaccaaacggtccctttacccctttacggaaacccctaactacccgtaccgtacgggggccttaccgaacggggtaacccgggaaacggtaacgttaggaacggggtaccttaagggtaaaccttaaagttttaagtttaacggggggttaaacggggttacccccggggggaaataaaggggtaaaacggttaaggggttaaaactttaaccgtaaggtttggggttacggggtttaccggggaaccgggggtaacgggggaaacccgtaaacgggttccgtacgggttaaccccggttacccgtaacgggttacccgacgggacccccgtaaacggggcccgttcccggaccccccccggttagggttaccccaacctttcccgttaacccccgg

SEQ ID NO: 375833 - DNA, 662 bp, Homo sapiens
  misc_feature: GZ8MTXP01ER0WU.2.21.B10.1.454.CMB.2.raw
  modified_base (246)..(246): a, c, t, g, unknown or other
  modified_base (485)..(485): a, c, t, g, unknown or other
tcagacgctcgacacacgaccggtgctcgatttagtgtcgtcgcaagagggagggggggctcagaagcagagttctggggtgtctccaccatggcctggacccctctctggctcactctcctcactctttgcataggttctgtggtttcttctgagctgactcaggaccctgctgtgtctgtggcctcgggacagacagtcaggatcacatcgaccaaaggagacagcctacaagtaacctattangacgaagttacggaccagacaagaacgccaggacacggccctagtaattgtacattactagtaggaatacttaagtaacggtaaaaaccgaaccccggtaccctacgaacgggacctacccgaacgtaccgtacttcctacgtcggtaccctacccgtaaactacgaacggaaaccacgtacgtcctttacctacgaccctaaatccgagtccggggactacggaacgggacggaaagngtagaggctagtacttagttagttagggggtaacggtacggggaactaggtaagtaggtaattacgaaggttcgggtagtcgggacgggtaacgggaacgtaagccggtacgaccgtaccgtacgcgacgttacccgaaggccctccgcccgtaccggctaaccgttccgttccccg

SEQ ID NO: 375834 - DNA, 677 bp, Homo sapiens
  misc_feature: GZ8MTXP01DHPK6.2.21.B10.1.454.CMB.2.raw
tcagacgctcgacacacgaccggtgctcgatttagtgtcgtcgcaagagggagggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagggagacagccctacaagtaaaccctattaatgacaagttggtaccagcagaacccgcgaggacacggcccctagtaattgtcatctatgaatactaataacggtaaaaccaacccggccctacgacgggactaccccgagacccgtacttcctacgtcggtccctaccctaaacctacgaacggaaaaccaccgtaacgtccttaccttacgaccctactccgtacgtcggggactcggagggtacggaaagagtaggaggtctagtaacttaagtttaagttacggggttaaacggtccggggaactaagggtaaagttaggtaaatttacgaggttgggttacggttacgggacgggaaggggtaacccaaggttccgtacggaccgtccgtaacggttcgaccgaccgaacgtccgtcccggccccgtccggttacctaaccgttcccgttccccg

SEQ ID NO: 375835 - DNA, 672 bp, Homo sapiens
  misc_feature: GZ8MTXP01AXB6O.2.21.B10.1.454.CMB.2.raw
  modified_base (240)..(240): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaacctattangacaagtgaccagcagaagcagacacggccctgtaatgtcatctatgaatctaatacggtaaaaaccacccggaccctacgacgggtacctacccgaacgaccgtacttcctacgtcggtccctaccctaaactacgaacggaaacacctaacgtccctttaccgttacgaaccctaacttcccgtaacggtcgggggtaccctacggaacgggacggtaaaggacgttagggacgggtacttagtaacttagtttaagttacggggtaaacggtacggggaacaaggtaaacgtaggttaaattacgtaagttgggttacggtacgggtacgggacggtaaccgaaggttcgtacggttaccgtaccgtacgttaccgcgttacccgaaggtccgtccgccccgtcgttcctaaccgttccgttaaccccg

SEQ ID NO: 375836 - DNA, 655 bp, Homo sapiens
  misc_feature: GZ8MTXP01BMGE2.2.21.B10.1.454.CMB.2.raw
  modified_base (516)..(516): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagtaacctattatgactaaggttcggtaccagcaagaacgccgaggacacggccctagtaattgtacatctataggaatactaataacggtaaaaaccacccggccctacgacggactacccagtaccgtacttctcgtcggtcctccctaaactacgaacggtaaacaccgtagtccttaccttacgacctactacctacgtcggggctacggaacggacggaaagtagtaggacgggtctacgtaacttaagtttagttacggggtaacgggttaccggggaanaaggtaaggttaggtaaacttacgtaggttggttaggttccgggacgggaacgggtaaccaaggttcgtacggacccgtcgtacgttacgcgacccgaaggcctcccgccccgttggccctaaccgttccgttccccgg

SEQ ID NO: 375837 - DNA, 604 bp, Homo sapiens
  misc_feature: GZ8MTXP01ER3QZ.2.21.B10.1.454.CMB.2.raw
  modified_base (228)..(228): a, c, t, g, unknown or other
  modified_base (262)..(262): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctanaagaacctattatgacaagttggtaccagcagancagacagccctgtaatgtcatctatggaatctaataggtaaaaacacccggcctacgaggactccagaccacttctctgctcctaactacaaggaaacacacgtccttaccttagacctatcacgtcggggctcgaggacggaaagagtggacgctaggaacttaagttaagttacggggtaaacggtccggggaaacaaggtaaagttaggtaaacttaacggtaagttgggttaggttacgggacgggtaagggaacctaaagcgtacgaccgtccgtaacgttcgacgttacccgaaggtcctaaccgccccgtacggttcctaaccgttcgttccccg

SEQ ID NO: 375838 - DNA, 662 bp, Homo sapiens
  misc_feature: GZ8MTXP01CFFG1.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaagggagacagcctacaagtaaccttattatgactaagttggtaccagcagaacgcaggacacggccctagtaattgcatctatggaatctaataacggtaaaaaccacccggtccctacgagggactacccgagaccgtacttcctctcggtcctcctaaacctacaacggaaaccactacgtccttaccttacgaacctatacctacggtcggggctacggaacgggtacggaaagtagtacgaggtctagtaacttagttagttacgggtaacgggtaccggggataaggtaagttaggttaaagttacgtaggttcgggtggttcgggacgggtaacgggaaccgtaacggttcgtacggacccggttactacggttcgacggttacccgaacgggtcccgtaaccgtcccccgtacggttcctaaccgttccgtttccccg

SEQ ID NO: 375839 - DNA, 586 bp, Homo sapiens
  misc_feature: GZ8MTXP01DV455.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctacaagaaccttattatgacaagttggtaccagcagaagcaggacaggcccctgtaattgtcatctatggaatctaataggtaaaaacacccggccctacagggactcccagaccgtattctctgcctcctaactcaaggaaacacagtcttccttgaccatcacgtgggctcgaggcggaaagagtgaggctagacttaagttacgttggggtaaaggtccgggggaacaaggtaagtaggttaaattacgagtgggtggttacgggcgggagggaaccaaggccgtacgttaccgtaccgtacgttccgacgaccccgaaggcctccgcccccgtggttcctaaccttcgtttccccg

SEQ ID NO: 375840 - DNA, 731 bp, Homo sapiens
  misc_feature: GZ8MTXP01BI9Q0.2.21.B10.1.454.CMB.2.raw
  modified_base (223)..(223): a, c, t, g, unknown or other
  modified_base (248)..(248): a, c, t, g, unknown or other
tcagacgctcgacacacgaccggtgctcgatttagtgtcgtcgcaagagggagggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaagganacagcctacaacgtaaccttattancgactaaggttcggtaaccagacaagaacgccgaaggacacggccctagtaattgtacatctaagtaggaacttacgtaaagtaaacggtaaaaaccgaccccggacccttacggaacgggtacctaaccccgaacggtaaccccgtaactttcctacgttaccggtaccttaccctaaaccgttaccgaacgggaaaacctaccgtacgttaccctttaccgttacgacctaacgtcgtacggtcgggctacggacgggacggaaagtcgtaggacggtactagtacttaagttacgtaggggtaacggtaccggggaataacggtaagttacgtaagttagtagggttggttcgggtacgggacgggtaacgggaaccgtaacggcgttaccggacccggttaccgtacggttaccgaccgacccggtaacggtcccgtcccgtacccccgtggttaccctaaccgttcccgttaaccccg

SEQ ID NO: 375841 - DNA, 677 bp, Homo sapiens
  misc_feature: GZ8MTXP01BXZ9Y.2.21.B10.1.454.CMB.2.raw
  modified_base (222)..(222): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaagganacagcctcaagtaaccttattatgacaagttggtacagcaagaacgcaggacacggccctagtaattgtcatctataggaatataatacggtaaaaccaccggccctacgacggactacccgacgaccgtacttcctacgtggccctacctaaacctacaaggaaaccacgacgtccttacctacgaccaactccgaacggtcggggtactacggaggacgggtaaacgagtacggacggacttagtaacttaagtttagttacggggtaaacggggttcccgggggaaataaagggtaaacggtaggttaaaacttacgtaaggttcggttacggggttacgggacgggtaacgggaacctaaggttccgtacggacccgtaccgttacggacgttaccggaccctaagggtccctccggccccctcggttaccctaaccgttccgttccccgg

SEQ ID NO: 375842 - DNA, 612 bp, Homo sapiens
  misc_feature: GZ8MTXP01DK7OL.2.21.B10.1.454.CMB.2.raw
  modified_base (303)..(303): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagtaacctattatgacaagttggtaccagcagaagccaggacacggcccctagtaattgtcatctatggaatntaataggtaaaacaccggcctcgaggactacccagaccgtattcctcgtggcctacctaactcaaggaaacacacgtctcctgaccatcacgtcggggctcgaggacggaaagcgtagacggactagaacttaatttagttaggggtaaacggttaccggggaactaaggtaaagttagggttaaacttacgtaaagttgggttaggttacgggacggtaacgggtaaccaaggttcgtacgaccgtccgtacgttacgacgacccgaacggcctccgtccccgtcggttccaaccgttccgttccccg

SEQ ID NO: 375843 - DNA, 557 bp, Homo sapiens
  misc_feature: GZ8MTXP01CZTIC.2.21.B10.1.454.CMB.2.raw
  modified_base (406)..(406): a, c, t, g, unknown or other
  modified_base (473)..(473): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaatgtcatctatggaatctaataggtaaaaacacccggcctacagggactcccagaccgtatcctctggcctcctaactcaaggaaacacacgcttcctagaccatcacgtggggctcgaggcggaaagntggagctgactattagttggggtaaagtcggggaacaggaagttggtaattacagtggtgttcgggnggagggaaccaaggctacggaccgtcgtacgttacgcgttacccaagggtcctccggccccgtcggttctaaccgttcgttccc

SEQ ID NO: 375844 - DNA, 661 bp, Homo sapiens
  misc_feature: GZ8MTXP01EX5ZE.2.21.B10.1.454.CMB.2.raw
  modified_base (277)..(277): a, c, t, g, unknown or other
  modified_base (336)..(336): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagaacctatatgacaagttgacagcagagcagcagccctagtatgcanctatgaatctaatacggtaaaacacccggacctacgaggactccagaccgtacttcctntacggctaccctaaacgtacaacggaaacacaacgtacctttccgttagaaccctactacacgtggggcctacggaaggccggaaaagagtaggaaggcctaggtaaacttaattaaggttagggttaaacggtacccgggggtaaactaaggtaaaggttaggttaaagttacgtaaggttcgggttacggtacggggacgggtaacgggaaccgtaacggttcgtaccggttaacccggttacccgtaaccggttaccgaccggacccgaacggtcccgtcccggtacccccgttacggttaccctaacccgttccgtcccgg

SEQ ID NO: 375845 - DNA, 766 bp, Homo sapiens
  misc_feature: GZ8MTXP01CAWVQ.2.21.B10.1.454.CMB.2.raw
  modified_base (245)..(245): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggagacagcctacaacgtaacctattangacaagttggtaccagcagaagccaaagacacggccctagtaattgcatctatgaatactaataacggtaaaaaccacccggacctacgacggactacccgagaaccgtacttcctcgtcggtccctaccgtaaactaccgtaaggaaacctacgacgttaccttacccttacgaaccctaactcccgtaaacggttcggggaccttaccggaacgggtaaccgggtaaaggacgttagggaacgggtacgttaacgtaaaccgttaagtttaacggtttaacgggggttaaacggggtttaccgggggaaactaagggtaaaacggttagggttaaacttacgtaaagggtttcgggttacggggtttacggggtaacgggaacgggggtaaacccgtaaacggccgttaacggttaaccccggttaacgtaacccgggttacgttaccggaccccgtaaagggtcccctaacccggtccccccggtccggttaccctaacccgttccgtttcccccggg

SEQ ID NO: 375846 - DNA, 610 bp, Homo sapiens
  misc_feature: GZ8MTXP01BZ50F.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaacctatatgacaagttggtaccagcagagccaggacaggccctgtaattgtcatctatggaatctaataggtaaaacacccggccctacgaggactacccagaccgtacttctctggtctccctaactcaaggaaaccacacgcttacctgaccactcacgtcgggctcgagggtcggaaagagtaggagtctagaacttagttagttacgggggtaaacggtcccggggaataacggtaaaggttacggtaaattaacgagttagggtggtttacgggacgggtacgggaacccgaaggttccgtacgacccgtccgtacgttcgacggcccgaaaggccgtaaccgcccccgtagttcctaaccgttccgttccccg

SEQ ID NO: 375847 - DNA, 810 bp, Homo sapiens
  misc_feature: GZ8MTXP01CZZZW.2.21.B10.1.454.CMB.2.raw
  modified_base (248)..(248): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttggacagacagtcaggatcacatgaccgaaaggagacacgcctacaacgtaaccttattagngacgtaaggttcgtaccagacaaggaacgaccaaggacacggaccctagtaatgtcatactagtagaatactaaagtaacggtaaaaaccaccggtaccctacgacggacaccgtaacgaccgtacttcctctcggacctacctaactaacaacggaaaccacgtacgtaccttaccttacgacctataccgacggtcgggggtaacctcggaacgggaaccggtaaaggtaacgtagggaaacgggttacctacgggtaaactttaaggtttaaggtttaacggggttaaaacgggggtaccgggggtaaactaaaggggtaaaggtttaaccgggttaaagtttaaccgtaaagggtttccggggtaagggtttaccgggggaaccgggggtaaacgggtaaacccgaaaacgggttcccggttaaccggttaaccccgggttaccccgtttaaacggttccccggttaaacccggttaccccggtaaacccgggccccgtccccggttaacccccccggttcggttacccgtaaccccgtttccccgtttaacccccgg

SEQ ID NO: 375848 - DNA, 704 bp, Homo sapiens
  misc_feature: GZ8MTXP01A6I9T.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaggagacagcctacaagtaaccttattatgacaagttcggtaccagacaagaacgccgaaggacacggcccctagtaattgtacatctataggaatctaatagtaaaacacccgcctacgaggactcccagaccgtacttcctactcggtcctacccgtaactacgaacggaaaccacacgtccttacctacgaacctactaccgtaacgtcggggacctacggacgggaaccgggaaagtagtaggacggacctagtaaccgttaagtttaacggttacggggttaaacggggttaccccgggggtaaactaaaggggtaaacggttaagggttaaacgtttaccgtaaaggttggggttacggggtttacggggacgggaacggggtaaccgaacggttcgtacggacccggttaccgtacgttaccgaccgacccggaaggtccgtccggccccgtcggttaccctaaccgttccgttccccggg

SEQ ID NO: 375849 - DNA, 759 bp, Homo sapiens
  misc_feature: GZ8MTXP01A51CB.2.21.B10.1.454.CMB.2.raw
  modified_base (219)..(219): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctacaacgtaaccttattatgactaagttcggtacagacaagaacgccgaggacacggccctagtaatgtacatactataggaatactaagtaacggtaaaaaccaacccggccctacgaagggacctacccgaagaaccctacttccgtctcggtaccctacccgtaaactaccgaacggaaacctacgaacgtcctttacccgttacgaccctagtccgtaacgtcggggactacggaagggaccggtaaagagtacgggaacggtacttacggtaaactttaagtttaacggttaacgggggttaaacggggttacccgggggtaaacgtaagggtaaaacggtttagggttaaaacgtttaaccgtaaagggtttggggttacggggtttaccggggaccgggggtaaacggggaacccctaaaggttcccgtaacggttaaccccgttaccggtaacgttaccgaccgttaacccgaacgggtcccgtcccggtacccccgtcggttaccctaaccgttcccgttccccg

SEQ ID NO: 375850 - DNA, 723 bp, Homo sapiens
  misc_feature: GZ8MTXP01CF1G7.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcaacagtcgacccgaaagggacgaaccacggccctacgaaacgtaaacccttattacgtgacgtaaggttcggaacagacaagaacgccgaaggaccacggtcccttagtaacttcgtactatacgtaagtaggtaacttacgtaaagtaacggtaaaaaccgaccccggtaccctaggacggtacctacccgaacgtaccgttacttccgtacgtcgtacccttaccgtaaacctaacgtaacggaaacctacgtacgttccttacctacgacctacgtacgtacggtcgggactacggacggacggaagtagtacggacgtcgtagtaacttaagttacgttacggggtaacgggtaccggggaataaggttaacggttaagttaacgtacggtaggttcgggttacgggtacgggacgggtaacggaacgacgttcgtaccgttaccgtaccgtacgttaccgcgacccgtaagtcccgtccgccccgtcgttacctccgttccgttaaccccg

SEQ ID NO: 375851 - DNA, 706 bp, Homo sapiens
  misc_feature: GZ8MTXP01B2D7E.2.21.B10.1.454.CMB.2.raw
  modified_base (221)..(221): a, c, t, g, unknown or other
  modified_base (244)..(244): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttctctgagctgactcaggaccctgctgtgtctggtggccttgggacagacagtcaggatcacatgaccaaagganacagcctacaagtaacctattangacaagttgaccagcagacgcaggacacgccctagtaatgacatctatagaatactaagtaacggtaaaaccaccggcctacgacggtacaccagaccgtacttctctgtcctacctaaacgtaccaacggaaacacgacgtcccttacctagaacctactccgacgtcggggacctacggaacgggtacggaaagtacgtaggacggtacctagtaacgttaagtttaaggttacggggtaaacggggttccggggaaactaaagggtaaacggttaggttaaaagttacgtaaggttgggttacggggttccggacgggggtaaaccggtaaaccgaaacggttcccggtaacggttaaccccggttacccgttaacggaccgttaccgaaccccggaacggtcccgtaaccccggtcccccgtacgggttacccctaacccgttcccgtttaacccccg

SEQ ID NO: 375852 - DNA, 667 bp, Homo sapiens
  misc_feature: GZ8MTXP01BFEIO.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctacaagtaacctattatgacaagttcggaccagacagaagccaaggacacgccctagtaatgtacatctataggaatacgtaagtaaggtaaaaaccaccggtaccctacgaaggactacccgagaccgtacttctctgtcctacctaaactacaacggaaacactaacgtcctttacctacgaacctacgtacctaacgtcggggacctacgacgggacggtaaaggacgtggaacggtctagtaattaagtttagttaggggtaaacgggtccggggaactaagggtaagtaggttaaacttagtacggttaggttcgggttaccgggacgggtaacgggaacccgaaggttccgttacggaacccgtaccgtaccgttaccgacggaccccgaaggtcccgtcccgtcccccgtcggttaccctaacgttccgttccccg

SEQ ID NO: 375853 - DNA, 704 bp, Homo sapiens
  misc_feature: GZ8MTXP01DJACB.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagaacagcctacaacgtaacctattatgactaagttcggaaccagacaagaacgccgaaggacaacggtccctagtaattgtcaatctagtaggaacttacgtaagtaaacggtaaaaaccacccggcctacgaggaacctccgagaccgtacttcctctggtccctcctaaacctacaacggtaaacacgtacgtccctttaccgtacgtaccactccgtaacggtcggggtcctaggaacgggacgggaaagtagtacggacggtctagtaaccttaagtttaggttacggggtaaacggggtacggggtaaactaagggtaaagttacggttaaattacggtaaggttacggggttacgggtacggggacgggaacgggtaacccgtaagggttcccgtacggttaccgttcccgtaacgttaccgacggaccccgtaacggccttcccgtaccccgtgttacccgtccgttccgttccccg

SEQ ID NO: 375854 - DNA, 799 bp, Homo sapiens
  misc_feature: GZ8MTXP01EEM92.2.21.B10.1.454.CMB.2.raw
  modified_base (221)..(221): a, c, t, g, unknown or other
  modified_base (230)..(230): a, c, t, g, unknown or other
  modified_base (245)..(245): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaagganacagcctanaacgtaacctattangactagttcgacagacagacgcgacgacgacgtccctagtaattcgtactatactagtaggtaaactcttaaagtaaacggttaaaaaacccgaccccggtccctaacggacggacctacccgaacggtaccgttaacttcctcgtacggtacccttaccctaaactacgaacgaaaccacgtacgtaccttacgttacgacctagtaccacggtcgggactacggaaggggaaccggtaagtagtacggtaggtccgttaagtaactttaagttaaggtttaacgggggtaccggggttaaaccgggggtaacaaagggttaaaggttaaggttaaaccgtttaacgaaggggttttaggggttacggggttaccggggtacgggggaaaccggggtaaaccgtaacgggttacccggtaaccgggttaaccccggttaccgttaaacccggttaccggttaacccggacccccgggttaaacgggccccggttaaccccgttaccccccggtccgggttaaccctccccggtttaacccgttttccccccgg

SEQ ID NO: 375855 - DNA, 826 bp, Homo sapiens
  misc_feature: GZ8MTXP01CTRP0.2.21.B10.1.454.CMB.2.raw
  modified_base (207)..(207): a, c, t, g, unknown or other
  modified_base (218)..(218): a, c, t, g, unknown or other
  modified_base (229)..(229): a, c, t, g, unknown or other
  modified_base (306)..(306): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttctctgagctgactcaggaccctgctgtgtctggtggccttgggacagacagtcaggatcanatgacaaaggngacagtcctanaagaacttatatgactaagttggaccagacagaagccaaggacacgccctagtaatgtacatctatagaatactaanaacggtaaaaaaccaccgggtaccctacgacgggtacctacccgaacgtaccgtaacttcggtactcggaccttaccttaaacgtaacgaacggtaaaaccacggtaaccgtaccttacccttacggaaccctaaattccgaacggttcgggggaaccctacggaacgggtaacgggaaaacgttaaacgggtacgggaacggtaacgttaacgttaaacgtttaaacgtttaaacggtttaacggggggtaaaccggggtaaaccgggggtaaacgttaaacgggtaaaacgggtttaaggttaaaaccgttacggttaaacgggtttcgggggttaaccggggtaaccgggggtaaccggggaaacggggttaaaccgtaacgggttacccggttaaccggttaaaccccggtaaccgttaaccggttaaccggaacccggttaacccgggtaaaccgttcccggtccccggtacccccggttaccggttacccttaacccgtttaaccccgttcccg

SEQ ID NO: 375856 - DNA, 741 bp, Homo sapiens
  misc_feature: GZ8MTXP01A9LB7.2.21.B10.1.454.CMB.2.raw
  modified_base (247)..(247): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatcgaccaaaggagacagccctacaagtaaccttattagngactaagttcggtaccagacaagaacgccgaaggacacggtccctagtaattcgtacatctaagtaggaacttacgtaaagtaaacggtaaaaaaccaaccccgggtaccctacgaacgggtacctacccgaacgtaacccgtacttcctacgtcggtacccttacccgtaaaccgtaccgaacgggtaaaaccctacgtaccggttaccctttaccgtaaccgtaacctaacgtccgtaaccggttcgggggacctacggaacgggtacgggaaagtacgtaggacggtacctagtaacttaagtttacgttaacgggggtaacggtacccggggtaaataagggtaaagttaagtaacgttagaacggtttggtacggggttacggacggggtaacggaacctacggttacgtccggaccgtaccgtacggttaccgacggacccgaaggtccctaaccgtccccgtcggttacctcccgttcgttcccccg

SEQ ID NO: 375857 - DNA, 658 bp, Homo sapiens
  misc_feature: GZ8MTXP01EW8L9.2.21.B10.1.454.CMB.2.raw
  modified_base (208)..(208): a, c, t, g, unknown or other
  modified_base (243)..(243): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttctctgagctgactcaggaccctgctgtgtctggtggccttgggacagacagtcaggatcanatcgaccaaggacacagcctacaagtaacctatangactaagttacgaacaagagaacgcgaaggacacggtccctagtaactgactatactagtagaacttactaagtaaacggtaaaaaccacccggtaccctaacggaacggacctacccgaacgacccgtactttccctccgtacggtcctaccctaaccgtaacgaagaacctacacgttccttacctacgacctatacgacgtgggactacggaggacgaagacgtggagcgtagtacttattagtaggtaacggggtacggaacgtaagtaagtagttaactacgtaggttagggtggtacgggacggtacggacgaagtccgttacggtaccgttaccgtacggtacgaccgcccgacggtcccgtcccgtccccgttacggtcccttaccgttcccgttcccgttcccccg

SEQ ID NO: 375858 - DNA, 712 bp, Homo sapiens
  misc_feature: GZ8MTXP01CJRMS.2.21.B10.1.454.CMB.2.raw
  modified_base (220)..(220): a, c, t, g, unknown or other
  modified_base (228)..(228): a, c, t, g, unknown or other
  modified_base (238)..(238): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggnacagcctnagaactatangacaagtgacagacagaacgcagacacgccctagtaattgtcatactagtaggaatctaatacggtaaaaaccacccggccctacgacggactacccgagacctacttctacgtcgactccctaaacgtacaacggaaacctactacgtacccttcgtaaccgacctaatccgtaacgtcggggacctacggaaggacccgggaaagtaggacggtaacggtacgttaacgtaaccgttaagtttaacgtttacgggggttaaaaccgggtaccccggggggtaaataaacggggtaaacgtttaagggttaaaaccgttacgtaaaggttgggggttaaccggttacgggggaacgggtaacggaaaccgtaaacggcgttaccgacccgtttaccgtaacggttcgaaccgaccccgtaacggccgttaaccccgccccgtacggttacctaacccgttccgtttaaccccg

SEQ ID NO: 375859 - DNA, 682 bp, Homo sapiens
  misc_feature: GZ8MTXP01BFFCT.2.21.B10.1.454.CMB.2.raw
  modified_base (221)..(221): a, c, t, g, unknown or other
  modified_base (245)..(245): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaagganacagcctacaacgtaacctattangacaaggttgacagcagagcaggcacgccctagtaatgtacatctatgaatacgtaataacggtaaaaccacccggtcctacgaggactacccagacctccttactcgtgtcctacctaactacaacgaaaccactagtcctttactacgacctactccacggttacggggactacggaacgggacggaaagtacgtaggtacgcgttacgtaactttaagtttagttaacgggggttaacggtaccggggtaaacgtagggtaaacgtttaggtaacgttaagtaaggttcgggttacgggttacggggaccgggtaacggtaacgtaacgggttccgtaccgggttacccgttaccgtaaccgttccgacggaccccgaacggtccctaaccccgggtacccccgtcggttacccttcccgttaaccttcccccg

SEQ ID NO: 375860 - DNA, 647 bp, Homo sapiens
  misc_feature: GZ8MTXP01DM3NN.2.21.B10.1.454.CMB.2.raw
  modified_base (223)..(223): a, c, t, g, unknown or other
  modified_base (232)..(232): a, c, t, g, unknown or other
  modified_base (246)..(246): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaaggganacagcctanaagtaacctattangacaagttcgaccagcaagaacgaccgaggacacggaccctagtaattgcatctaatgaatactaagtaacggtaaaaacacccgcctagacggtacctaccacgacctactctgtcgcctacctaactacgaacgaaactacacgttcctaccttcgaacctataccgacggtacggggtcctacggaacgggtacggaaagtagtacgacgggtacaagtaacttaagttaagttaggggtaacgggtaccggaagtaaaggtaagtaagttaattacgtaggttggtagggttccggacgggaacggaacctaagcgtaacgttcccgtaaccgtacgttaccgcgaccccgaaggtcccgtaacccgccccgtgttacctcccgttcgttaaccccg

SEQ ID NO: 375861 - DNA, 665 bp, Homo sapiens
  misc_feature: GZ8MTXP01A4B3F.2.21.B10.1.454.CMB.2.raw
  modified_base (246)..(246): a, c, t, g, unknown or other
  modified_base (409)..(409): a, c, t, g, unknown or other
  modified_base (471)..(471): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtgccgttggacagacagtcaggatcacatgaccgaaaggagacagcctacaacgtaaccttattangactaaggtcgtacagacagaacgcaagacgacgccctagtattgtcatctataggtaaatacgtaagtaaacgtaaaaaccgacccggtacctacggacggaccttacccgaacgaccggtaacttcgttcgcggtacctacctaaacaccgaaggaaaccncgtaaacgtccttaccgtacgaacctactaccgtacgtcgggcctagacgggtacgaaacgngtaggacgactagttaaacttagttacgttagggtaacggtaccggggtaagaagttaacggttagtaagttagtagtggggtacgttacgggcggaagggaacgcgttacggtccggttacgtacccgtacgacgttaccggaccgtaagggtccctccgggtcccacggttctaaccttccgtttaaccccg

SEQ ID NO: 375862 - DNA, 798 bp, Homo sapiens
  misc_feature: GZ8MTXP01B77ZE.2.21.B10.1.454.CMB.2.raw
  modified_base (326)..(326): a, c, t, g, unknown or other
tcagacgctcgacacacgaccggtgctcgatttagtgtcgtcgcaagagagagaggtgccttagccctgaattccaaggcatttccacttggtgatcagcactgaacacagaggactcaccatggagttggggctgtgcttgggttttccttgttgcttattttagaaggtgtccagtgtgaggtgcagcgtgggtggagtcggtgggggagtcttagggtacaggccgttgggacgggtcccctggacgtacctctcctgtcgcgacgtcctgtggtacttcctacctttagagttagttatagtaaatggtaacgtcgggtccncgacggtcgtacggaggggagggtcgtagggtggttggttacatacgtattacgtaggtagtacggtaactacctattacttactacggaactacgtcgtcgtagggtacgggtacggggccttacttacccgacctacttcctaccgaagacgaaaccgaacccgaacccaacgtaaccgttacctaacttaacgttaacttaaacctaaactaaaacgggtacgtaaacccggtacgtcccggttaaaggaaccgggaccgaaccgggtaaccgggaacgttacgggttaccgttttagttttaacggttaacggtcggttacgggtaacggttaaaggttaaaaccgttaaacggttttaccggttttaaggtttttagggggttaacgttttacggggtttaaactttaaccccgggttaacccggttacccccgggggttaacgtttcccggggtttaaaccccggg

SEQ ID NO: 375863 - DNA, 605 bp, Homo sapiens
  misc_feature: GZ8MTXP01A2DCK.2.21.B10.1.454.CMB.2.raw
  modified_base (241)..(241): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgaccaaggagacagcctacagaacctattangacaagttgtaccagcagaagcagacagccctgtaatgcatctatgaatctagtaacggtaaaaccacccggccctacgacggactacccgagaccgtacttcctacgtcggaccttaccctaacgtacgaacggaaaccactaacgtcccttaccgttacacctaactcacgtgggactcgaggacggaagagtggacgtctagaacttagttaagttaggggtaaacggttcccggggaactaagggtaagtaggttaattacgtagttggtaggtcggacggaggtaaccgaagttcgtacgccgtactacgcgcgttcccaaggcctccgccccgtggttcctaacttccgttaaccccg

SEQ ID NO: 375864 - DNA, 729 bp, Homo sapiens
  misc_feature: GZ8MTXP01AWWYV.2.21.B10.1.454.CMB.2.raw
  modified_base (348)..(348): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacgaacgtaaacctattatgactaaggttcgtaaccagacaagaagccgaggaccacggccctagtaacttgcatctatgaatctaagtaacgtaaaaccgacccgtcctacgaggtacnccgaacgaccgtacttcctgtcgtcctaccctaactacgaacgaaaccacgtaccgtactttacctagacctacgtcacggtcgggtactacgagggaacgtaagtagtcgaacgcttacggaactttaagtttaacggttacgggggtaaacccggggttaccgggggaaactaaggggtaaacggtttaacggtaaacgttaaaccgtaaggtttcgggggttaacgggttaccgggggaacgggttaacggggaaacccgtaagggttacccggttaacgggttacccgttacccggttaacgacccggaccgacccggtaacggtcccgtcccgggtacccccgttcgggaaccttccggttcccgtttcccccggg

SEQ ID NO: 375865 - DNA, 760 bp, Homo sapiens
  misc_feature: GZ8MTXP01ASU1P.2.21.B10.1.454.CMB.2.raw
  modified_base (175)..(175): a, c, t, g, unknown or other
  modified_base (255)..(255): a, c, t, g, unknown or other
tcagacgctcgacacacgaccggtgctcgatttagtgtcgtcgcaagagggaggggggctcagaagcagagttctggggtgtctccaccagtggcctggacccctctctggctcactctcctcactctttgcataggttctgtggtttcttctgagctgactcaggcctgctgtntctgtggccttgggacagacagtccaggatcacatcggacctaaagggacacaaggcccttgaacggtaaccttattagngactaaggttcggtaccagctaagaacgacaggacacggtcccctagtaacgttcgtactaatctaagtaggtaaacttactaaagtaacggttaaaaaaccgaccccggtacccgttacggaacgggaccttaccccgaaggtaccctaaccgttcgtaccgtacggtaccctaccctaaacgtaccaagggaaaccctacgtaaggtccctttaccgtacggaaaccctagttacgaacggttcggggacctacggaacggggacggtaaacggtaggttaccggagggtaccttagggttaacctttaagtttaaccggttaggggtaaccggggttaaccgggggaactaaaggttaaccggtaagttaaaccgttacgtacggttaggggttcggttacggggacggtaacgggtaacccgaaagttcgtacggttacccgtacgtcggttacgccgttaccgaagtccgtccgtacccgcgttctaacgttcgtccccg

SEQ ID NO: 375866 - DNA, 725 bp, Homo sapiens
  misc_feature: GZ8MTXP01CIKT8.2.21.B10.1.454.CMB.2.raw
  modified_base (220)..(220): a, c, t, g, unknown or other
  modified_base (246)..(246): a, c, t, g, unknown or other
  modified_base (265)..(265): a, c, t, g, unknown or other
  modified_base (294)..(294): a, c, t, g, unknown or other
  modified_base (346)..(346): a, c, t, g, unknown or other
  modified_base (374)..(374): a, c, t, g, unknown or other
  modified_base (408)..(408): a, c, t, g, unknown or other
tcagacgctcgacacacgaccggtgctcgatttagtgtcgtcgcaagagggagggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgacaagganacagcctacaagtaaacctattaacngactagtacggtaccaganagaaagcagacgacgaccctagtaacttntacatcatagaatactaagaacggtaaaacacccgtactcgaagctaccganaccgtaattcctagtcgctacccgtaanaacgaacggtaacacgtaactccgttaccgtaanaccctaagtccgtacgtacgggacgtacgaaagggacggtaaagacgtacggagtaccgtagtaacgtaagtttaaggttaacgggggttaaacgggtaaccgggggtaaataaacgggttaacggttaaacggttaaagttaacgttaaggttcggggttaacgggttaccggggtaccggggaaagggtaaaccggtaacggttaccgtacccgttacccggttaaccgtaccggttaaccgacccgttacccgtaaccgggtcccgttccccgccccggtttacccgttaccttaaccccgttccggtttcccc

SEQ ID NO: 375867 - DNA, 516 bp, Homo sapiens
  misc_feature: GZ8MTXP02G4XDD.2.21.B10.1.454.CMB.2.raw
  modified_base (225)..(225): a, c, t, g, unknown or other
  modified_base (333)..(333): a, c, t, g, unknown or other
  modified_base (391)..(391): a, c, t, g, unknown or other
  modified_base (423)..(423): a, c, t, g, unknown or other
tcagacgctcgacacacgaccggtgctcgatttagtgtcgtcgcaagagggaggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaacctattatgcaagttggtaccagcagaagccaggacaggcccctgtaatgtcatctatggaatctataggtaaaacaccggcctcaggatcccagaccgattcnctggctcctactcaggaaacacagcttcctgaccatcactgggactcgaggcgaaagntgaggctgactattattagtaagtccgggganaggaagtgtaaattagatggtgtcggcgagggaccaaggctagaccgtcgtacgtcagcccaaggcctcgccccctggtccaccgtcttcccg

SEQ ID NO: 375868 - DNA, 561 bp, Homo sapiens
  misc_feature: GZ8MTXP02JMDFX.2.21.B10.1.454.CMB.2.raw
  modified_base (392)..(392): a, c, t, g, unknown or other
  modified_base (436)..(436): a, c, t, g, unknown or other
tcagacgctcgacacacgaccggtgctcgatttagtgtcgtcgcaagagggaggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggaccagcagaagccaggacaggcccctgtaatgtcatctatggaatctataggtaaaaacaccggcctacaggatcccagaccgattctctgctcctactcaggaaacacagcttcctgaccatcacgtggggctcgaggcgaaagngtgaagggctagacttaattagttaggtaaacggtccggggaanagggtaaagtggtaaattacgaagttgggtagttcgggacgggagggtaacccaaaggccgtacggaacccgtccgtaacggtcacggacccaaggcctcgccccctggtaccacctcttcccgg

SEQ ID NO: 375869 - DNA, 498 bp, Homo sapiens
  misc_feature: GZ8MTXP02HJ971.2.21.B10.1.454.CMB.2.raw
  modified_base (389)..(389): a, c, t, g, unknown or other
  modified_base (418)..(418): a, c, t, g, unknown or other
tcagacgctcgacacacgaccggtgctcgatttagtgtcgtcgcaagagggaggggctcagaagcagagttctgggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaatgtcatctatggaatctatggtaaaaacaaccggcctcagggatcccagaccgatctctgctctactcaggaaacacagcttccttgaccatcactggggctcgaggcgaagntgaggctgactattattgtaagtcggganagaagtgtaattacatggtgttcggcgaggacaagctgaccgtctacgtcagcccaaggctcgcccctggtcactctccg

SEQ ID NO: 375870 - DNA, 511 bp, Homo sapiens
  misc_feature: GZ8MTXP02IOUTA.2.21.B10.1.454.CMB.2.raw
  modified_base (391)..(391): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaatgtcatctatggaatctataggtaaaacaccggccctcagggatcccagaccgattctctggctcctactcaggaaacacagcttcctgaccatcactgggctcaggcgaagntgaggctgactattattgtaagtccgggacagaagtggtaatacagtggtgttcgggacggtagggaccaagctcgaccgtcctacgtcagcccaaggctacgcccctggtcactctccg

SEQ ID NO: 375871 - DNA, 699 bp, Homo sapiens
  misc_feature: GZ8MTXP02IS8ZU.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgacaagttggtaccagcagaagccaggacacggcccctagtaattgtcatctatggaatctataggtaaaacaacccggccctcgagggatcccagaccgattctctgcctcctactcaggaaacacacgtccttccttgaacctataccacgtggggctaccgagggaccggaaagacgtaggaacggctacggaacttagtttaagtttggttaaacggttcccgggggaacagggtaaaagttagggttaaaacgtttaaaccgtaaggttaagggtttcggtttaccgggggacggggaaaccgggggtaaaaccgaaacgggtaccggttaccggtaaaacccccggttcccgttaaacccggttacccgaaccggtacccccgaaaacggggtccccgttaccggtaccccccccgttcggggttaccctaacccggtttacctttaccccccgg

SEQ ID NO: 375872 - DNA, 589 bp, Homo sapiens
  misc_feature: GZ8MTXP02HIUFF.2.21.B10.1.454.CMB.2.raw
  modified_base (322)..(322): a, c, t, g, unknown or other
  modified_base (443)..(443): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctagtaattgtcatctatggaatctataggtaaaaacaacccggccctanagggactacccagaccgacttctctacggctacctactcaggaaacacagtcttccttgacccatcacgtggggctcgaggcgaagatgaggctagactattattaggaaggtccgggaanaggtaaagtggtaaattacgagttgggtcgttacgggacgggaagggtaccaaaggtctacggaacccgtaccgttaccgaccgaccgtacccgaaacgggtcctacccggtccccccgtggtacccctaacgttcccgttcccgg

SEQ ID NO: 375873 - DNA, 611 bp, Homo sapiens
  misc_feature: GZ8MTXP02HU6H4.2.21.B10.1.454.CMB.2.raw
  modified_base (240)..(240): a, c, t, g, unknown or other
  modified_base (288)..(288): a, c, t, g, unknown or other
  modified_base (356)..(356): a, c, t, g, unknown or other
  modified_base (375)..(375): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctacaataacctattangacaagtgtaccagcagaagcagacaggcccctagtaatgtcatctangaatctataggtaaaacaccgcctagaggactccagaccgatctactcgcctctacctcacggaaacncagtccttacctgacctancacgtgggctcgaggcgaaagacgtgaggctagaacttatttagttagtaacggttacccggggaataagggaaagttaggtaaattacgtaaagtggggttaggttacgggacggggaacgggtaaccgaaaaggtccgtacggtaaacccggttacctaccggtaccgaaccggaacccgaaaacgggtcctacccggtaccccccgtggtaccctaaccttccgtttaccccg

SEQ ID NO: 375874 - DNA, 531 bp, Homo sapiens
  misc_feature: GZ8MTXP02F58GS.2.21.B10.1.454.CMB.2.raw
  modified_base (316)..(316): a, c, t, g, unknown or other
  modified_base (334)..(334): a, c, t, g, unknown or other
  modified_base (353)..(353): a, c, t, g, unknown or other
  modified_base (390)..(390): a, c, t, g, unknown or other
  modified_base (392)..(392): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaaagttggtaccagcagaagccaggacaggcccctgtaattgcatctatggaatctatggtaaaaacaccggcctnaggactccagaccattcnctgctctactcaggaaacncagccttcctgaccatcacgtgggctcaggcgaaagngngagctagtacttattagtagtaacggtcgggataaggtaagtagtaattacgagttggtgtcgggacggacggactagcgtacgaccgtctacgtcacgaccgaacggtcctaccgaccccgtgtacctacgttctccg

SEQ ID NO: 375875 - DNA, 550 bp, Homo sapiens
  misc_feature: GZ8MTXP02F6KRF.2.21.B10.1.454.CMB.2.raw
  modified_base (217)..(217): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggngacagcctcagaacctattatgcaagttggtaccagcagaaagccaggacaggcccctgtaattgtcatctatggaatctaataggtaaaaacaccggcctagaggactccagaccgattctctggcctcctactcaggaaacacagccttcctgaccatcacgtgggctcgaggacgaagctgaaggctagacttattagtgtaacggtcggggaacaggaagtaggtaattacgagttgggtgttacgggacggaaggaaccaaggtctacggacccgttactacgacacgacccaaagggtcctacgccccctggtccacgtcttacccg

SEQ ID NO: 375876 - DNA, 564 bp, Homo sapiens
  misc_feature: GZ8MTXP02J0Y5R.2.21.B10.1.454.CMB.2.raw
  modified_base (312)..(312): a, c, t, g, unknown or other
  modified_base (423)..(423): a, c, t, g, unknown or other
tcagacgctcgacacacgaccggtgctcgatttagtgtcgtcgcaagagggagggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagcaggacaggcccctgtaatgtcatctatggatctataggtaaaacacgcctnaggactccagaccgactctctgctcctactcagaaacacagcttctcgaccatcacgtgggctcgaggcgaagagtgaggctagacttattagttagtaaggtccgggganaaggtaaagtaggtaaacttaacgagttggtggttacgggacgggaagggaccaaaggcgtacggtaaccgtccgtacgtccgaacggaccccgtaaagggccttccggcccccgttacgggtcctaacctccgttccccg

SEQ ID NO: 375877 - DNA, 522 bp, Homo sapiens
  misc_feature: GZ8MTXP02HAJPI.2.21.B10.1.454.CMB.2.raw
  modified_base (330)..(330): a, c, t, g, unknown or other
  modified_base (390)..(390): a, c, t, g, unknown or other
  modified_base (421)..(421): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaatgcatctatgaatctataggtaaaacaccggcctgaggatccagaccgatcnctgctctactcagaaacacagtccttcctacgaccatcacgtggggctcgaggcgaaagntgaggctagacttatattagaagtccggganaggaagtaggtaatacgagtggtagttcggaggaggtaaccagcgtcgaaccgtcctacgtccagcccaaggtcctccgcccccgtggtccacctctcccg

SEQ ID NO: 375878 - DNA, 555 bp, Homo sapiens
  misc_feature: GZ8MTXP02HY8RO.2.21.B10.1.454.CMB.2.raw
  modified_base (208)..(208): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagcgtgactcaggaccctgctgtgtctgtggccttgggacagacagtcaggatcanatgccaaggagacagcctcaagaacctattatgacaagttggtaccagcagaagccaggacaggcccctgtaattgcatctatggaatctaatacggtaaaaacaacccgggccctagaacgggactaccccgagacccgatttcctctcggcttcctaactcaggaaaccactacgtcctttaccttcgacctataccacgtcggggctcgagggcgaagagtggagcgtgtatattattagtaggtacggacgagagtagtatagtagtgtgtcgcggaggacgagacgacgacgtccgtacgtacgacgaccgaacgcgtccgcccgtccgtccgctcgtcccg

SEQ ID NO: 375879 - DNA, 666 bp, Homo sapiens
  misc_feature: GZ8MTXP02F92GS.2.21.B10.1.454.CMB.2.raw
  modified_base (412)..(412): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagtaacctattatgcaagttggtaccagcagaagccaggacaggcccctgtaattgcatctatggaatctaataggtaaaacaccggccctacgaggactccagaccgacttcctctagcctcctactcaggaaacacgacgcttaccttagacctatacacgtcggggctacgaggacggaagngtaggacggtctacgtacttaagtttagttaacggtaacggttaccgggggactaaagggtaacgttacgggttaaactttacgaagtttggggttacggttaccggggtacggggtaacgggtaaccgaaacggtacggttaccggtaacccgttacccgtaaccggttaccgaccgggtaaccccgtaaaccgggtcccgttacccggtacccccccgttcgggtaccctaacccgttccgtttacccccgg

SEQ ID NO: 375880 - DNA, 634 bp, Homo sapiens
  misc_feature: GZ8MTXP02HKR3E.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctataggtaaaacacccggcctacgaggactccagaccgacttctctcggctcctactcaggaaacacacgtccttccttagaccatcacgtcggggctcgaggcgaagacgtggacggctaggaacttaagtttaagttacggtaaacggtaccgggggaactaagggtaaaggttaggttaaaacgtttaacgaagttgggttaggtttaccggggacgggtaacgggtaaccgaaaacggcgttacggtacccgttaccgtaaccgtaccgaaccgaccccgaaacggtccctacccggtacccccgttccggtacctacccgttccgtttccccgg

SEQ ID NO: 375881 - DNA, 686 bp, Homo sapiens
  misc_feature: GZ8MTXP02JPTGK.2.21.B10.1.454.CMB.2.raw
  modified_base (240)..(240): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacagaacctattangacaagttgtaccagcagaagcaggacacggccctagtaatgtcatctatggatctataggtaaaacaccggcctacgaggactccagaccgtacttctctcgcctcctactacgaggtaaaccacgacgtccttaccgttacgaacctactaccgtacggtcgggggacctacggaacggggaccgggaaagtacggtacggaacgggtaccgttaggtaacctttaaagtttaacgtttagggttaaaccggggttaccgggggaaactaaagggtaaaggttacgggttaaatttaacggtaggttagggttcgggttacggggacgggaacgggtaacccgtaaaggtccgtacggtacccgtacccgtaacggtaccgaaccggtacccgaacggtccgtacccggcccccgtacggtccctaccgttcccgtttccccgg

SEQ ID NO: 375882 - DNA, 556 bp, Homo sapiens
  misc_feature: GZ8MTXP02FT9JC.2.21.B10.1.454.CMB.2.raw
  modified_base (399)..(399): a, c, t, g, unknown or other
  modified_base (436)..(436): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaatgcatctatggaatctataggtaaaaacaccggccctacgaggactccagaccgacttctctgctctactcaggaaacacagtccttcctgaccatcacgtggggctacgaggcgaaagngagagctagacttattagtaggtaacggtaccggganaaggtaagttagtaaattagtagttggtggtcgggacgagtacggacgtagcgtacgtaccgtccgtacgtacgaccgaacccgacggccctcccggtccccgtcggtacctacgttccg

SEQ ID NO: 375883 - DNA, 623 bp, Homo sapiens
  misc_feature: GZ8MTXP02HJTMZ.2.21.B10.1.454.CMB.2.raw
  modified_base (244)..(244): a, c, t, g, unknown or other
  modified_base (389)..(389): a, c, t, g, unknown or other
tcagacgctcgacacacgaccggtgctcgatttagtgtcgtcgcaagagggagggggctcagaagcagagttctggggtgtctccaccatggcctggaccccctctctggctcactctcctcactctttgcataggttctgtggtttcttctgagctgactcaggaccctgctgtgtctggtggccttgggacagacagtcaggatcacatgaccaaaggagacagcctacaagaacctattangacaagttgaccagcagaagccaggacaggcccctagtaatgtcatctatggaatctaataggtaaaaaccaccggcctacgaggactacccgagaccgattctactggcctctactcagaaacacagtccttacctagacctanctacgtgggctacgaggcgaagagtggacgtacgtagaacttagtttagtacggtaacgggttaccgggaataagggtaaagttagggttaaaattacgaagtttgggtaggttaccgggtagggaacgggtaacccaaggtaccgtacgacccggttaccttacggtaccaacggaccccgaaaggtcccgtacccgtacccccgtcggtacccaaccgtttcgttcccccgg

SEQ ID NO: 375884 - DNA, 618 bp, Homo sapiens
  misc_feature: GZ8MTXP02JC7AN.2.21.B10.1.454.CMB.2.raw
  modified_base (420)..(420): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgccaaggagacagcctcagaacctattatgcaagttggtaccagcagaagccaggacacggcccctgtaatgtcatctatggaatctaataggtaaaaacaccggcctacgagggactcccagaccgattcctctcggccttcctactcgacggaaacacacgtccttccttagacccatccgacgtggggacctcgaaggaccgaaagntaggaaggtctagaacttagtttattaggttaaacggtccggggaacagggtaaagtggtaaattacgagttgggttcgttacgggacgggacgggtaaccaaggtccgtacggaacccggttccgtacggtaccgacgtacccccgaaaggtcccgtaccggtaccccccgttggtaccctacgttccgtttccccg

SEQ ID NO: 375885 - DNA, 564 bp, Homo sapiens
  misc_feature: GZ8MTXP02JVFNS.2.21.B10.1.454.CMB.2.raw
  modified_base (218)..(218): a, c, t, g, unknown or other
  modified_base (227)..(227): a, c, t, g, unknown or other
  modified_base (445)..(445): a, c, t, g, unknown or other
tcagacgctcgacacacgaccggtgctcgatttagtgtcgtcgcaagagaggagggggctcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatgccaaaggngacagcctnagaacctatatgtcagttggtacagacagaacgccaggacacggcccctgtaattgtacatctagtggaactcgtataggtaaaacaccggtcctacacgggactacccgagaccccgatctactcggctccatcaagaaacacagcttcctgaccatcacgtggggctcgaggacgtagagtgagctagactagttacgttaggtaacgtccggganaagtaaggtaggttaaagttacgagtcggtaggttcgggacggtacggaccgaaagccgtacggaccgtcctacgtccgacgcccgaacggcctccggccccctcggtccacgttcccg

SEQ ID NO: 375886 - DNA, 553 bp, Homo sapiens
  misc_feature: GZ8MTXP02IRLBB.2.21.B10.1.454.CMB.2.raw
  modified_base (227)..(227): a, c, t, g, unknown or other
  modified_base (462)..(462): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctnaagaacctattatgcaagttggtaccagcagaagccaggacaggcccctgtaactgtcatctatggaatctatagtaaaacaaccgcctcaggatccagaccactctctgctcctactcaggaaacacagcttcctgaccatcagtgggctcgaggcgaagacgtgaggctagactaattagttagtaaggttccgggacgaggtaagtagtaattacgagttaggtgttcgggngggaacgggacgaaaggcctacggaccgttacctaccgtacacgacccgaaggcctaccggtcccccgtggtccctaccgtcgtttccccg

SEQ ID NO: 375887 - DNA, 577 bp, Homo sapiens
  misc_feature: GZ8MTXP02JXJHA.2.21.B10.1.454.CMB.2.raw
  modified_base (414)..(414): a, c, t, g, unknown or other
tcagacgctcgacacacgaccggtgctcgatttagtgtcgtcgcaagagggagggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaaggagacagcctcaagaacctattatgcaagtgtaccagcagaagcaggacacggcccctgtaattgtcatctatggaatctaataggtaaaaaccaccggccctagagggactcccagaccgacttctctcgctcctactacacggaaacacacgtctcctcgaccatccacgtggggactcgaggacgaagatggagntagaacttagttattaggtaacggtccggggaatagggtaatggtaaattacgagtggtaggtcgggtacggaacgggtacaaaggctacggacccgtccgtaacgccgaacgacccgaagggtccctaccggcccccgttcggacctaccgtccgtttcccg

SEQ ID NO: 375888 - DNA, 611 bp, Homo sapiens
  misc_feature: GZ8MTXP02IN0PV.2.21.B10.1.454.CMB.2.raw
  modified_base (461)..(461): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctatatgcaagttgtaccagcagaagccaggacaggcccctgtaattgtcatctatggaatactaataggtaaaaaccaacccggccctacgacgggactaccccagaccgacttcctcgtcggcctcctactcaggaaacacagtcttccttgaccatcacgtcggggctacgagggacggaaagacgtggaaggctagacttattagttagtaaacggtccggggaanaggtaaagtggttaaattacgtagttggtggtttacgggacgggaagggtacccgaaaggccgtacgggtaaccccgtacgtaccgtaccgacgacccccgaagggtcccttccggccccccgttcggtacctacccttcgtttccccgg

SEQ ID NO: 375889 - DNA, 548 bp, Homo sapiens
  misc_feature: GZ8MTXP02HW5VH.2.21.B10.1.454.CMB.2.raw
  modified_base (207)..(207): a, c, t, g, unknown or other
  modified_base (226)..(226): a, c, t, g, unknown or other
  modified_base (239)..(239): a, c, t, g, unknown or other
  modified_base (281)..(281): a, c, t, g, unknown or other
  modified_base (456)..(456): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggttttcttctgagctgactcaggaccctgctgtgtctgtggccttggacagacagtcaggatcanatgccaaggagacagcctnaagaacctattangacaagtgaccagcagaagccaggacaggcccctgtaatgtnatctatagaatctataaggtaaaaacaccggaccctagaggactacccagaccgtacttctactcggcctcctactacaggaaaccacacgtccttacctagaccatccacgtcggggcctacgagggcgaagagtggaaggctagaacttattagttaggtaaggtccgggaanaggaagtaggtaatacgagtggtgtcggacggaggaccaagctacgaccgtctacgcacgcccgaagcctcgccccctggacctactctccg

SEQ ID NO: 375890 - DNA, 493 bp, Homo sapiens
  misc_feature: GZ8MTXP02GVN4Y.2.21.B10.1.454.CMB.2.raw
  modified_base (389)..(389): a, c, t, g, unknown or other
  modified_base (394)..(394): a, c, t, g, unknown or other
  modified_base (415)..(415): a, c, t, g, unknown or other
  modified_base (420)..(420): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgcatctatggaatctatggtaaaaacaccggcctcagggactccagaccgatctctgctctactcaggaaacacagcttccttgaccatcagtgggctcgaggcgaagntgagntgactattatgtagtcggganagagngtaatacagtggtgtcggcgaggacaagctcgaccgtctacgtcagcccaagctcgcccctggccactctccg

SEQ ID NO: 375891 - DNA, 603 bp, Homo sapiens
  misc_feature: GZ8MTXP02I3ILJ.2.21.B10.1.454.CMB.2.raw
  modified_base (238)..(238): a, c, t, g, unknown or other
  modified_base (473)..(473): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattangacaagttggtaccagcagaagccaggacaggcccctgtaattgcatctatggaatctaataggtaaaacaccggcctacaggactacccgagaccgattctcgtgcctacctactcacggaaaccacaacgtccttcctacgaacctataccacgtcgggggacctacgaagggacgaaagagtaggaaggtccgtagaacttaagttacgtttaggtaacggtccgggggaanagggtaaagtaggtaaattacgagttgggttgttacgggacggtaagggaccaaggcctacggacccgttacgtacgtacgacggacccgaaggcctaccggccccctggtacctaccgttccgttcccg

SEQ ID NO: 375892 - DNA, 573 bp, Homo sapiens
  misc_feature: GZ8MTXP02G6DMS.2.21.B10.1.454.CMB.2.raw
  modified_base (348)..(348): a, c, t, g, unknown or other
  modified_base (357)..(357): a, c, t, g, unknown or other
  modified_base (431)..(431): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagtggtaccagcagaagccaggacaggcccctgtaatgtcatctatggaatctataggtaaaaacaccggcctcagggactcccagaccgattctctggctcctacncaggaaacncagcttcctgaccatcacgtcggggctacgaggacgaagagtgaggctgactattactagtaacggtccggganaggtagtaggtaaattacgagtgggtgttcgggacgggtaagggaccaaggtctacggtaacccgtccttacggaccacggacccccgaaagggcccttaccggcccccccgttgggtacctacccgttcccgtttccccgg

SEQ ID NO: 375893 - DNA, 557 bp, Homo sapiens
  misc_feature: GZ8MTXP02FXADK.2.21.B10.1.454.CMB.2.raw
  modified_base (417)..(417): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaaccctattatgacaagttggtaccagcagaagccaggacaggcccctgtaatgcatctatggaatctaataggtaaaaacacccggacctagacgggactacccgagaccgtacttctactgcctcctactacaggaaacacagtccttcctagaccatacacgtcggggctacgaggacgaagngtagaggtctagacttaagttagtaggtaaacggtccggggataaggaagtaggtaatacagtggtagtacgggaggaggaccaagctacgaccgtactacgtcacgaccgaaggctacgcccctggtacactcgttccc

SEQ ID NO: 375894 - DNA, 622 bp, Homo sapiens
  misc_feature: GZ8MTXP02FK064.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctcaagaacctattatgcaagttggtaccagcagaagccaggacacggcccctagtaattgcatctataggaatctaagtaacggtaaaaacacccggaccctagagggactccgaagaccgtattcctactgtcctacctactacgaggaaacacacgtccttaccttacgaaccacttacacgtcggggctacgaggacggaagagtgaaggtctagacttaagttagttaggtaacggtccggggaaataaggtaaagttaggttaaattacgtaggttaggttaggttcgggacgggaacgggtaaccaaggtcgtacggaacccgttcgtaccgtacaccggaccgaacggccgtaccggtccccctacgggtccctaccgttcgttacccg

SEQ ID NO: 375895 - DNA, 532 bp, Homo sapiens
  misc_feature: GZ8MTXP02JNXKV.2.21.B10.1.454.CMB.2.raw
  modified_base (217)..(217): a, c, t, g, unknown or other
  modified_base (225)..(225): a, c, t, g, unknown or other
  modified_base (315)..(315): a, c, t, g, unknown or other
  modified_base (331)..(331): a, c, t, g, unknown or other
  modified_base (349)..(349): a, c, t, g, unknown or other
  modified_base (375)..(375): a, c, t, g, unknown or other
  modified_base (380)..(380): a, c, t, g, unknown or other
  modified_base (386)..(386): a, c, t, g, unknown or other
  modified_base (393)..(393): a, c, t, g, unknown or other
  modified_base (428)..(428): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttggacagacagtcaggatcacatgccaagganacagcctnagaacctattatgcaagttgtaccagcagaagccaggacaggcccctgtaattgtcatctatggaatctataggtaaaacaacggccctnaggatccagaccatcnctgctcacgcaggaaacncagcttcctgaccatcaactggggcncaggnggaaanatgaganagatatatagtagtacggagagaagtagtaagtanagtagtagtacggacggacggacgaacgacgtacgtaccgtaccgtaccgtaccgacgaccgaaccgacgtaccgtaccccgtaccgtaccgtacctacctccg

SEQ ID NO: 375896 - DNA, 591 bp, Homo sapiens
  misc_feature: GZ8MTXP02JGG0E.2.21.B10.1.454.CMB.2.raw
  modified_base (363)..(363): a, c, t, g, unknown or other
  modified_base (403)..(403): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacagaacctattatgcaagtggtaccagcagaagccaggacaggcccctagtaattgtacatctatggaatctataggtaaaaaccaccggcctagaggactcccagaccgatctctgctcctactcagaaacacanccttcctagaccatccgactggggctcgagggaccgaagngtaggacggctagacttagttagttggtaaacggtcggggaacaaggtaagtaaggtaattacgaagttggtaggttcgggacggggtaacggacccgaaaggtccgtacggtaacccgtaccgtaacgtccgaaccggcccgtaaacggccgtccgacccccgttcggtaccaccttccgttccccg

SEQ ID NO: 375897 - DNA, 554 bp, Homo sapiens
  misc_feature: GZ8MTXP02I1LGO.2.21.B10.1.454.CMB.2.raw
  modified_base (226)..(226): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaacctattatgcaagttggtaccagcagaagccaggacaggcccctgtaatgtcatctatgaatctataggtaaaacaccgcctcaggatcccagaccgattctctggctctactcaggaacacagcttcctgaccatcacgtggggctcgaggcgaagactgagctagacttattattaggtaacgttaccggggacaggttaagtaggttaattacgagttagggttgttacgggacgggtaagggaccgaaggtcgtacggacccgtcctacgtaccgacgacccgaaggcctacggccccctggtacctcgtacctttcccg

SEQ ID NO: 375898 - DNA, 696 bp, Homo sapiens
  misc_feature: GZ8MTXP02GGGUL.2.21.B10.1.454.CMB.2.raw
  modified_base (357)..(357): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagccctacaagaacctattatgactaaggttggtaccagcagaagccaggacacgacccctgtaattgtcatctataggaatactaagtacggtaaaaacacccggcctacgaggactaccgacgaccgattccncgtcgctacctactacgagaaacacagtccttacctacgaccataccgtaacgtcggggactacgagggacggaaagtacgtaggacggtcgtacgaacttaaattagtttagggtaaacgggttaccgggggaacaaagggtaaacggtaaggttaaacgttacgtaaggtttcgggtaggtttaccgggggacggggtaaacgggaacccgtaagggtacccgttacggaacccccggttaaccgttaaccggtacccgaacggaccccgtaaaacgggtccccgtccggtacccccccgttcgggtaccctaacccgtttcccgtttaacccccgg

SEQ ID NO: 375899 - DNA, 663 bp, Homo sapiens
  misc_feature: GZ8MTXP02HRZ8N.2.21.B10.1.454.CMB.2.raw
  modified_base (218)..(218): a, c, t, g, unknown or other
  modified_base (239)..(239): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcaagaacctattangacaagttgtaccagcagaagccaggacacggcccctagtaattcgtcatctatggaatctaatacggtaaaaacaccggaccctagaggactacccagaccgtactcctctcgacctctaacctacacggtaaacacacgtacctttcccttaggaccctaactccgaaacgtcggggacctacgacgggtaccgtaaagagttcggaggtacctagtaacttaatttaacgttaggtaaacgggttcccggggaataagggtaaagttaggtaaaattacgaaaggtttcgggtaacggtttcggggaacggggaacgggtaaccgaaggtcgttccggtaaccggttcccgtaaccgtcgaacccgaccgtaaacggccgtaccggcccccgttacggacctcccgtttccgttcccccgg

SEQ ID NO: 375900 - DNA, 571 bp, Homo sapiens
  misc_feature: GZ8MTXP02IZFV3.2.21.B10.1.454.CMB.2.raw
  modified_base (229)..(229): a, c, t, g, unknown or other
  modified_base (242)..(242): a, c, t, g, unknown or other
  modified_base (347)..(347): a, c, t, g, unknown or other
  modified_base (459)..(459): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgaccaaggagacagcctanaagaacctattangacaagttgaccagcagaagccagacaggcccctgtaatgcatctatggaatctaataggtaaaaaccaccggccctacgagggactcccgaagaccgaacttcncgtggtcctacctactcgaaggaaaccacgacgccttaccttagacccatccacgtggggacctcgagacagaaagactagagctagtaactattataggtagaccgggtanaagaagtagtaaattacgagttgggtacgttcgggacgggtaaggaccaaggtcctaggacccgtcctaacggcaacggaacccgaagctaccgacccagtccggactaccg

SEQ ID NO: 375901 - DNA, 580 bp, Homo sapiens
  misc_feature: GZ8MTXP02G6YG9.2.21.B10.1.454.CMB.2.raw
  modified_base (377)..(377): a, c, t, g, unknown or other
  modified_base (416)..(416): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaacctattatgacaagttggtaccagcagaagccaggacagcccctgtaattgtacatctatggaatctataggtaaaaacaacccggccctacacgggactaccccgaagaccgacttctacgtggactcctactcacggaaacncacgtcttcctcgaccatcacgtgggctcgaggcgaagngtagaggactgaactattagttagtaacggtccggggtacaggtaacgtaggtaattacgagtggtgttacggacgggtaggaaccgaagcgtacggtaaccgtccgtacgtccgacgtacccgaaggtccctacggccccctacggcctaccgtctttccccg

SEQ ID NO: 375902 - DNA, 627 bp, Homo sapiens
  misc_feature: GZ8MTXP02HJ0KG.2.21.B10.1.454.CMB.2.raw
  modified_base (229)..(229): a, c, t, g, unknown or other
  modified_base (243)..(243): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagccctanaagaaccctattangactaagttggaccagtcaagaacgccaggacacggcccctagtaattgtcatctatagatctaagtaggtaaaaaccaccggaccctacgacggactacccgaagaccgtacttcctacgtcgtacctacctactacacggaaaccacacgtccttaccgttacgaaccctataccgacgtacggggcctacgacggacgaagatggaaggctagaacttagttaagttaggtaacggtaccgggaataaggtaagttagtaaattacgagttggtaggttacgggcgggaacgggaccaaggtccgtacgtacccggtactaccggtacacgtacccgaacggcctacccggcccccgtaggtccctaccgttcgttccccg

SEQ ID NO: 375903 - DNA, 515 bp, Homo sapiens
  misc_feature: GZ8MTXP02GLFGD.2.21.B10.1.454.CMB.2.raw
  modified_base (219)..(219): a, c, t, g, unknown or other
  modified_base (323)..(323): a, c, t, g, unknown or other
  modified_base (400)..(400): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaagganacagcctcagaacctattatgcaagttggtaccagcagaagccaggacaggcccctgtaattgcatctatggaaatctaataggtaaaaaccaaccggccctanagggactcccagaccgattcactgctctactcagaaacacagccttcctagaccatcacgtgggctcgaggcgaagntggagctagactattagtgtaacgtcgggacagaagtgtaatacgatggtgtcggaggaggactagctcgaccgtctacgtcacgacctaaggctacgccccgagtcactctccg

SEQ ID NO: 375904 - DNA, 590 bp, Homo sapiens
  misc_feature: GZ8MTXP02HPP0G.2.21.B10.1.454.CMB.2.raw
tcagacgctcgacacacgaccggtgctcgatttagtgtcgtcgcaagagagagaggtgccttagccctgaattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagcctgggacgggtccctgagctctcctgtgcagcctctggattcaccttcagttagttatagaaatgaacgtgggtccgccgaggcctccgaggggaaggggctgggtagttgggtttcatacattaactagtagtggtactaccatatacttagcagactctgtgaacggggcctattacacatctaccagacgacaaccgcccaagtaacctcactagtaatactaaacaaatacgaaacacaccgtagacgacgaccgtaaggacgacggtcttagtttacttaacgtgtagacgaaggtaaactaacgttaacgttagttttggaagtttagtttaacttactaccgaccccggtactttacgtaaccgg

SEQ ID NO: 375905 - DNA, 595 bp, Homo sapiens
  misc_feature: GZ8MTXP02GMLHS.2.21.B10.1.454.CMB.2.raw
  modified_base (409)..(409): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgacaagttggtaccagcagaagccagacacggcccctagtaatgtcatctatggaatctatagtaaaacacccggcctacgaggactcccagaccgattctctgcctcctactcgacggaaacacacgtccttcctagacctatccacgtcggggctacgaggacgaaagngtaggaggtctagtacttaagtttagttaggtaaacggtcccgggggaatagggtaaagttaggttaaacttacgtagttgggttgttacggggacgggtaacgggaccaaggcgtacggtaccgtccgtacgtacgacgacccgaacggcctaccgcccccgtacggtacctacgttccttcccg

SEQ ID NO: 375906 - DNA, 885 bp, Homo sapiens
  misc_feature: GZ8MTXP02GTYX4.2.21.B10.1.454.CMB.2.raw
tcagacgctcgacacacgaccggtgctcgatttagtgtcgtcgcaagagagagaggtgccttagccctgaattccaaggcatttccacttggtgatcagcactgaacacagaggactcaccatggagttggggctgtgctgggtttccttgttgctattttagaaggtgtccagtgtgaggtgcagctggtggagtcgtgggggagcttggtacagcctgggacgggtccctggacgacctctcctgtgcagcctgtggacttcaccttcagtagttatagaaatcgaacgtcgggtcccgaccgaggtccgtacccggagggggaacggggtcgtaggggtacgggtttcggggttttacaagttaacctaagttttaaaccgttaaggggtttaaaggttacggggttaaaccgttaaccctaatttaaagttaaactttaccggactaaggtacccttcgttaggggttaacgggaaaccgggggtacccccgttaagtttaccccaacccgtaaacgttacccttaccccgaaaggaaaccggaaacccgaaaaccccggacccccgaaaccggtaaacccttacccgtaaccttacggtttaaacttaaacccgttaaacctaaaaacgttaccggaaaaccgaacggtaccccgttaaggaacggaaaccgggacccgggaaacggggtaaccgaaccgggggttacgttttaacggttttaacgtttaaccgttaggtacggtaaccggttaaagggtaaaacggtttaaaaccgttttacggtttaaggttttttaggggtaacggttttagggttttaaacgtttaacggttaaccccggtaacccccggggtttaccgtttacggttaaacccgg

SEQ ID NO: 375907 - DNA, 557 bp, Homo sapiens
  misc_feature: GZ8MTXP02J259B.2.21.B10.1.454.CMB.2.raw
  modified_base (217)..(217): a, c, t, g, unknown or other
  modified_base (226)..(226): a, c, t, g, unknown or other
  modified_base (233)..(233): a, c, t, g, unknown or other
  modified_base (236)..(236): a, c, t, g, unknown or other
  modified_base (335)..(335): a, c, t, g, unknown or other
  modified_base (425)..(425): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggngacagcctnagaactntangcaagtgacagcagagccagacaggccctgtaatgcatctatggaatctaataggtaaaaaccaccggcctacgagggactacccgagaccgatttccncgtggctcctacacacggaaacacagcttaccttgaccagtccagtggctcgaggcgagatgagctgactattagtgaagtccgggaaanaggtagtagtaagttacgagttcggtaggtacgggacggtacggaccgaagtccgtacggtaaccgttccgtacgaccgaccggacccgaaggtccctacccggccccgttcggtacctaccgttcctcccg

SEQ ID NO: 375908 - DNA, 565 bp, Homo sapiens
  misc_feature: GZ8MTXP02FTYWN.2.21.B10.1.454.CMB.2.raw
  modified_base (317)..(317): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagccctcagaacctattatgcaagttggtaccagcagaagccaggacaggcccctgtaattgcatctatggaatctataggtaaaacaccggcctnagggactcccagaccgattcctctggcctcctactcaggaaacacagccttcctgaccatcacgtcggggctcgaggcggaagagtggaggctagacttattagttaggtaacggtccggggaacaagggtaaacgttagggttaaattacgtagttggtggttacgggcggtaagggaccaagctacggaccgtccgtacgtcacggacccaaggcctaccgcccccgtggtacctacctcgtcccg

SEQ ID NO: 375909 - DNA, 676 bp, Homo sapiens
  misc_feature: GZ8MTXP02GRRL7.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagccctacaagaaaccttattatgactaagttggtaccagcaagaagccaggacacggcccctagtaattgtcatctatggaatctaatacggtaaaaacacccggcctacgacggactacccgagaccgtattcctctcggcctacctactcgaggaaaccacgaacgtccttaccttacgaacctactaccgacgtcgggggtactacggaagggaccggaaagtacgtaggaacggtctacgtaacttaagtttagttaggtaacgggttaccggggaactaagggtaaaggttagttaaacgttacgtaggttcgggttaggtacggggtacgggaacgggtaaaccgaggtaccgtacggtaacccgttaccgtaaccgtaccgaaccggaccccgtaaaggtcccgtaaccggtcccccgtcggtacccgtacttccccgtttccccg

SEQ ID NO: 375910 - DNA, 635 bp, Homo sapiens
  misc_feature: GZ8MTXP02HT6WF.2.21.B10.1.454.CMB.2.raw
  modified_base (241)..(241): a, c, t, g, unknown or other
  modified_base (291)..(291): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctacaagaacctattangacaagttgaccagcagaagccaggacacggccctagtaatgtcatctanggaatctaagtaaggtaaaaaccaccggcctagagggactcccgagaccgacttctacgtggccttacctactacacggaaaccactacgtcccttacctacgacctactacctacgtggggcctacgagggacggaaagagtaggacggtactagtaacttagtttagttaggtaacgggttacgggaactaaggtaagttaggtaaattaacgtagttgggttaggttacgggacggtaacgggtaaccaaggtccgtacgacccgttacctaccggtccgaacggacccgtaaaggtccttacccggcccccgttaggtccctaaccgtttcgttcccccg

SEQ ID NO: 375911 - DNA, 623 bp, Homo sapiens
  misc_feature: GZ8MTXP02IYICK.2.21.B10.1.454.CMB.2.raw
  modified_base (239)..(239): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattangcaagttggtaccagcagaagccaggacaggcccctgtaattgtcatctatggaatctataggtaaaacaccgcctacaggatcccagaccgatctctgctctactcagaaacacagccttcctgaccatcacgtgggctacgaggtcggaaagacgtgaggtctagacttaattagttaggtaaacggttccggggaactaaggtaaacggtaggtaaattaacgagttaggggttcggttacgggtacggggaacggggtaaccgaaagggtccgtacgggaaccccggttaccgtaaccggttaccgaaccggaccccgtaaaacgggtcccgtaccggtacccccccgtacgggttacccaacccgttccgtttcccccg

SEQ ID NO: 375912 - DNA, 639 bp, Homo sapiens
  misc_feature: GZ8MTXP02IM0C7.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcaagaaccttattatgacaagttggtaccagcagaagccaggacaggcccctgtaattgtcatctatggaatctaataggtaaaacaacccggccctacagggactacccagaccgattccactcgctcctactcacggaaacacacgccttcctgaccatcacgtggggcctacgagggacgaagagtggagcgtagacttaagttaatttagtaacggttaccggggacgtaaggtaaaggtagttaaagttacgtagttaggggttacggtttacggggacgggtaagggtaaccgaaaggtccgttacggtaaccccgttacccgttaaccggttacccgacggtaccccgtaaaaggtcccgtcccggtaccccccgttcgggtaccctacccgttacgtttcccccg

SEQ ID NO: 375913 - DNA, 635 bp, Homo sapiens
  misc_feature: GZ8MTXP02G4GZN.2.21.B10.1.454.CMB.2.raw
  modified_base (221)..(221): a, c, t, g, unknown or other
  modified_base (246)..(246): a, c, t, g, unknown or other
  modified_base (493)..(493): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatcgaccaagganacacgcctacaacgaaccttattangactaagttgtaccagcagaacgccaggacacggcccctagtaactgtacatctataggaatctaataaggtaaaaaccgacccggtaccctacgacggactaccgaacgtaccgaccttctctcggcctacctactacgacgtaaacacacgtccttacttacgacctactaccgacgtcgggctacgacgggacgaaagcgtaggacgtctagtacttagttacgttagtaacggtccggggaanaagggttaagtaggttaaactagtagttaggtgttacgggacgggacggtaacgacgcgtacgacccggttacgtacgtaccgaccggacccgtaacggcccgtaccggtaccccctcggaacctcccgttaccgttccccg

SEQ ID NO: 375914 - DNA, 676 bp, Homo sapiens
  misc_feature: GZ8MTXP02HCSZP.2.21.B10.1.454.CMB.2.raw
tcagacgctcgacacacgaccggtgctcgatttagtgtcgtcgcaagagggaggggggctcagaagcagagttctggggtgtctccaccatggcctggaccccctctctggctcactctcctcactctttgcataggttctgtggttttcttctgagctgactcaggaccctgctgtgtctggtggccttgggacagacagtcaggatcacatgccaaggagacagcctacagaaccttattatgacaagttgtaccagcaagaagccaggacacggcccctagtaatgtacatctatagaatactaataacggtaaaaacaacccggaccctacgacggaaaaactcccaagaccgtacttcctacgtcgcctacctactacgaacggtaaaccaactaacgtacctttacccttacgaaccctaacgtacctaacgtcgggggtctacggacgggacggaaagaagtaggaacggtactagtaacttaaagtttacgttacggtaaacgggttccggggaaacgtaagggtaaaggttagggttaaaagttacgtaagttgggttacggttacgggacggggaaacggtaccgaaaggccgtacgacccgtacctacgtaccgacgaccgaacggtcctacccggcccccgtacgtaccctaccttcctccccg

SEQ ID NO: 375915 - DNA, 618 bp, Homo sapiens
  misc_feature: GZ8MTXP02F6MF3.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagccctcagaacctattatgcaagttggtaccagcagaagccaggacacggcccctagtaattgtcatctatggaatctaatacggtaaaaacacccggccctacgagggactacccagaccgacttcctctcggcctcctactacaggaaaccacacgtccttcctagaccatcacgtggggctcgaggacggaagacgtggaggctagaacttagttagttaggtaacggtccggggaacaagggtaaagttagggtaaattacgtagttagggttcggttacgggacggggtaagggaaccctaaggcctacggaacccgttcgtaaccgtaccgaccggaccccgaagggtcctacccggcccccgttacggtacctaccgttccgttaccccg

SEQ ID NO: 375916 - DNA, 531 bp, Homo sapiens
  misc_feature: GZ8MTXP02F2H0O.2.21.B10.1.454.CMB.2.raw
  modified_base (316)..(316): a, c, t, g, unknown or other
  modified_base (378)..(378): a, c, t, g, unknown or other
  modified_base (425)..(425): a, c, t, g, unknown or other
  modified_base (455)..(455): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtgccttgggacagacagtcaggatcacatgaccaaggagacagcctcaagaacctattatgcaaagttggtacagcagaagccaggacaggcccctgtaattgtcatctatggaatctatggtaaaacaccggcctnagggactccagaccatctctggctctactcaggaaacacagcttccttgaccatcatggctnaggcgaagatcgaaggctagacttattagttagtaaggtccgggaanagaagtagtaattcaagtggtgttacgggnggtacggaacgagcgtcgacccgtactacgtacgacgcccgaagtcctcgaccccctcggtacacctcctttcccg

SEQ ID NO: 375917 - DNA, 683 bp, Homo sapiens
  misc_feature: GZ8MTXP02HMVO2.2.21.B10.1.454.CMB.2.raw
  modified_base (242)..(242): a, c, t, g, unknown or other
  modified_base (360)..(360): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatgaccaaaggagacagcctacaagaacctattangacaagttggaccagcagaagccaggacacggcccctagtaattgtacatctataggtaatctaatacggtaaaaaccaccggtaccctacaagggactaccccgagaccgtacttcnctacgccttacctactacacggaaacacacgtccttaccttacgaacctactctaaccgtcgggggtactacgagggaccgggaagagttacggaacggtcgtagtaacttaagttaacgtttaggtaaacgggttacccggggaataagggtaaaggtaggttaaacttaacggtaaggttggggttacggttacgggggacggggtaacgggaaccgtaacggtccgtacggtaacccggttaccgtaaccggtccgtaaccggacccgtaacggtccctaaccggtcccccgtacggtcctaaccgttccgtttaccccg

SEQ ID NO: 375918 - DNA, 581 bp, Homo sapiens
  misc_feature: GZ8MTXP02HA8I3.2.21.B10.1.454.CMB.2.raw
  modified_base (241)..(241): a, c, t, g, unknown or other
  modified_base (452)..(452): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaataacctattangacaagttgtaccagcagaagcaggacacggcccctgtaatgtcatctatgaatctatagtaaaacaccgcctagaggactccacgaccgtaacttcctcgtcgcctaccgtactacacggaaacacgaacgtccttccttacgaccatcacgtgggactcgaggacgaagatagagctagacttagttattaggtaacggtaccgggaanaagggtaaagttaggttaaactacgtagttaggtggttacgggacggaacgggaccgaaggtcgtacgaccgttaccgtacgtccgaacgccgaacgcgtccgaccccgtggaccaccgttactccccg

SEQ ID NO: 375919 - DNA, 757 bp, Homo sapiens
  misc_feature: GZ8MTXP02G24BF.2.21.B10.1.454.CMB.2.raw
  modified_base (219)..(219): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttctctgagctgactcaggaccctgctgtgtctgtggccttgggacagacagtcaggatcacatgaccaaagganacagcctacaacgtaacctattatgactaagttcggtaccagcaagaacgccaggacacggacccctagtaattgacatctataggaatactaagtaacggtaaaaaccgacccggtacccgtacgacgggaacctacccgaacgtaccgtaacgttcctaccgtacggtacccttaccctaacttaccgaacgggaaaccacgtaccggtaccctttacccgttacgaaccctactaccgtaccgtacggggtacctacggaacgggacggtaaagacggtacggacggtacctaggtaaccttaaagtttacgttaagggtaaacgggttacccggggaagtaagggttaaaggttaacggttaaacgtttaacgtaagggtttacggggttacgggtttaccggggaacggggaacgggtaaaccgtaacgggtaccgttacggacccggttacccgtaccggtacccgaaccggtacccgtaacggtccgtaccccgtaccccgtcggtacccctaccgttccgtttacccccg

SEQ ID NO: 375920 - DNA, 612 bp, Homo sapiens
  misc_feature: GZ8MTXP02HUBJL.2.21.B10.1.454.CMB.2.raw
  modified_base (239)..(239): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaacctattangacaagttggtaccagcagaagccaggacacggcccctagtaatgtcatctatggaatctaataggtaaaaaccaccggcctacaggactcccagaccgtattctctgcctctactcacggaaacacagccttactacgaccatcacgtgggctcgaggacgaagagtgaggctagacttaattagttagtaaggttccggggaactaaggtaagttacgtaaagttaacgagttggggttacgttacggggagggtaaacgggtaccgaaaggtcggtacgaacccgttaccgtaccggtaccaaccggaccccgaaagggtcccgtaccggtccccccgtacgggtaccctacccgtttaccgttaccccg

SEQ ID NO: 375921 - DNA, 628 bp, Homo sapiens
  misc_feature: GZ8MTXP02HPO3A.2.21.B10.1.454.CMB.2.raw
  modified_base (238)..(238): a, c, t, g, unknown or other
  modified_base (471)..(471): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattangcaagttgtaccagcagaacgccaggacacggcccctagtaacttgtcagtctatggaatctagtacggtaaaacaccggcctacgacgggactacccagaaccgacttctactggcctacctactcgacggaaaccacacgcttacctgaacctatcacgtggggctacgagggacgaagagtcggaggactagtactaagttacgtttggtaaacggttacccgggggaanaaagggtaaagtcgggttaaattacggagttagggttaggttcgggacggggacgggtaaccaagggtcctacggtaacccgttccgtaaccggtcaaccggaccccggaaggtccgtaccgtcccccgtacggttccaaccgtttccgttaccccg

SEQ ID NO: 375922 - DNA, 709 bp, Homo sapiens
  misc_feature: GZ8MTXP02IT2JM.2.21.B10.1.454.CMB.2.raw
  modified_base (218)..(218): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggngacagcctcagaaccttatatgcaagttggtaccagcagaagccaggacacggcccctgtaattgcatctatgaatctatagtaaaacaccggcctcgaggactccacgaccgtatctctggctcctactcaggaaacacacgtccttcctagaccatcacgtcggggctacgacggacggaaagacgtaggacggtactacgtaacgtttaatttaaggtttaggttaaaaccgggttccgggggtaaacctaaggggtaaaaggttaccgggtttaaaagtttaacgtagtttaacgggggttgggtttaccgggggtaccgggggaaacgggggtaacccggaaacgggtacccgttacgggtaaacccccggttacccgttaaccgggttaccgtaaccggtacccccggtaaaagggggtcccctttaccccgggaccccccccgttcggggtaacccctacccgtttaccccgttttacccccgg

SEQ ID NO: 375923 - DNA, 667 bp, Homo sapiens
  misc_feature: GZ8MTXP02HMG9L.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacacgcctacaacgtaaaccttattatgactaagttcggtaccagcagaacgccgaggacacggcccctagtattcgtacatctatagaatactaataacgaaaaacacccgtacctacgaggacctaccgacgtaaccgtacttcctacgtcgtacctacctactacgacggaaaccacgtacgtacctttacccgtacgacctactaccgacgtcggggtctacgagggacgaaagagtacggacgctagaacttattagttacggtaacggtaccggggaataacggtaaggttacgttaaagttaacgtaggttgggttacgggttacgggtacgggaacggggtaaccgaaggtacggtaccggtaccgttaccgtaccggtccaccggtacccgaacggtcctcccggtccccgtcgtacctacctttccgttacccccg

SEQ ID NO: 375924 - DNA, 521 bp, Homo sapiens
  misc_feature: GZ8MTXP02J0DDD.2.21.B10.1.454.CMB.2.raw
  modified_base (227)..(227): a, c, t, g, unknown or other
  modified_base (318)..(318): a, c, t, g, unknown or other
  modified_base (339)..(339): a, c, t, g, unknown or other
  modified_base (359)..(359): a, c, t, g, unknown or other
  modified_base (426)..(426): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagccctnagaacctattatgcaagttggtaccagcagaagccaggacaggcccctgtaattgtcatctatggaatctataggtaaaaacaccggcctnagggactcccagaccgattcnctggctccactcaggaaacncagctccttgaccatcacgtggggctacgaggcggaagatggaagctgactattatgaagtcggganagaagtgtaattacgatggtagttcggcggagggaccaagctaggaacccgtctaacgtcacgcccaaggctcggccccctggtcaccgtctccg

SEQ ID NO: 375925 - DNA, 578 bp, Homo sapiens
  misc_feature: GZ8MTXP02JJJRT.2.21.B10.1.454.CMB.2.raw
  modified_base (274)..(274): a, c, t, g, unknown or other
  modified_base (377)..(377): a, c, t, g, unknown or other
  modified_base (382)..(382): a, c, t, g, unknown or other
  modified_base (395)..(395): a, c, t, g, unknown or other
  modified_base (398)..(398): a, c, t, g, unknown or other
  modified_base (403)..(403): a, c, t, g, unknown or other
  modified_base (430)..(430): a, c, t, g, unknown or other
tcagacgctcgacacacgaccggtgctcgatttagtgtcgtcgcaagagagagaggtgccttagccctgaattccaaggcatttccacttggtgatcagcactgaacacagaggactcaccatggagttggggctgtgcttgggttttccttgttgcttattttagaaggtgtccagtgtgaggtgcagctggtggagtcgtgggggagcttggtacagccgtgggaggtccctgacgtactctcctgtgcagtcctctggtacttcacccttnagttagttatagaaaatgaacgtgggtcccgacgaggctccggaaggggaaggggctgggagtggtttcatactattacgtagtagtggtatacatatattcnagctngtagagcatcacntcncaganacacgcacactacactagtatactaanaaatacgaacagaccgtagagacgacggacgacgacgtacgttagttaacttacgtgtacggacgaaacgtaagtaaacgtttaacgtttagttttaggaagttaggttaacttactaaccggtaacccggtacgttacgtaacccgg

SEQ ID NO: 375926 - DNA, 645 bp, Homo sapiens
  misc_feature: GZ8MTXP02H4YC6.2.21.B10.1.454.CMB.2.raw
  modified_base (244)..(244): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggttttcttctgagctgactcaggaccctgttgtgtctgtggccttgggacagacagtcaggatcaacatgaccaaggagacacgcctcaagtaacctattangactaagttggtaccagcagaacgacaggacacgcccctagtattgtacatctataggatactaataacggtaaaaaccacccggaccctacgaacgggtactacccgacgaaccgtacttcctcgtcgtctacctacgtacgaacgaacacgtactccttactacgacccatccgacgtcggactcgaggacggaagagtgagtcagtacttaagtagttaaggtaacggtcggggtaacgtaagggtaaggttacgtaaagttacgaaggttcgggttaggttacgggacgggaacgggtaccaaacggtcgtacggtacccgtaccgtacgttacgaccgtaccgaacggtccgtacccgtacccccgtacggtccaccgttccgtaccgtttccccc

SEQ ID NO: 375927 - DNA, 565 bp, Homo sapiens
  misc_feature: GZ8MTXP02GJQAR.2.21.B10.1.454.CMB.2.raw
  modified_base (228)..(228): a, c, t, g, unknown or other
  modified_base (280)..(280): a, c, t, g, unknown or other
  modified_base (291)..(291): a, c, t, g, unknown or other
  modified_base (456)..(456): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctanagaacctattatgcaagttggtaccagcagagcaggacagcccctgtaatgnatctatgaatntataggtaaaaacaccggcctacagggactccagacgactctctgctctactcagaaacacagccttctgaccatacacgtcggggctaccgaggacgtaaagatgaaggctagacttattaagttaggtaacggtccgggaacaggaaagttaggtaacttaanagttggtggttacgggacgggaagggaaccaagcgtacggaccgtaccgtacgtacacggtacccgaaacggccgtaccgcccccgtcggtacctaccgtcctttcccg

SEQ ID NO: 375928 - DNA, 601 bp, Homo sapiens
  misc_feature: GZ8MTXP02GGFUU.2.21.B10.1.454.CMB.2.raw
  modified_base (218)..(218): a, c, t, g, unknown or other
  modified_base (227)..(227): a, c, t, g, unknown or other
  modified_base (294)..(294): a, c, t, g, unknown or other
  modified_base (402)..(402): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagccctnagaacctattatgacaagttggtaccagcagaagccaggacaggcccctgtaatgcatctatgaatntatagtaaaacaccgcctacgaggactccagacgatctctgacctctactcacggaaacacacgtcttcctagacctaatcaacgtcggggctacgagggaccgaaangtgaacggtctaggaccttattaacgtttagggaaacggttcccggggaataagggtaagtagggttaaacttagagttagggtggttacggggacgggtagggaaccctaaaggctacggaacccgttcctaaaccgggtcaaccggcccgtaaaggtccctccggccccctcgggtcctaccggtctttacccccgg

SEQ ID NO: 375929 - DNA, 590 bp, Homo sapiens
  misc_feature: GZ8MTXP02G4SGQ.2.21.B10.1.454.CMB.2.raw
  modified_base (218)..(218): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcagaacctatatgcaagtgtacagcagaagcagacacgcccctagtaattgtcatctatgaatctataggtaaaacaccggcctacaggactcccagacgacttctactggcctcctactcaggaaacacagtaccttccttacgaccactacacgtcggggctacgaagggcggaaagagtggaaggtctagaacttaatttagttaggtaaacggtccggggaactaagggtaagtaggtaaattacagttggttggttacgggacgggtaacggaaccaggtcgtacgaaccggttaccgtacgtaccgacgtacccgaacgtccgtcccgacccccgtggtaccctaccgtccgttccccg

SEQ ID NO: 375930 - DNA, 612 bp, Homo sapiens
  misc_feature: GZ8MTXP02JKFOI.2.21.B10.1.454.CMB.2.raw
  modified_base (319)..(319): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaacctattatgctaagttggtaccagcagaagccaggacacggcccctgtaatgtcatctatggaatctataggtaaaacaccggcctanaggactcccgagaccgacttctctcggcctcctactcaggaaacactacgccttccttacgacccatccgacgtcggggcctacgagggaccggaaagagtacggaggctagaacttaagttacgttaggtaaacgggtccggggaaactagggtaaacgttaggttaaatacgtagttagggtaggttaccggggacgggaacgggaaccgaaggccgtacggacccgttaccgtaccgtccgaacgcccgaaaggcccgtccgacccccgtggtaccaccgttcttccccg

SEQ ID NO: 375931 - DNA, 703 bp, Homo sapiens
  misc_feature: GZ8MTXP02JONO8.2.21.B10.1.454.CMB.2.raw
  modified_base (227)..(227): a, c, t, g, unknown or other
  modified_base (240)..(240): a, c, t, g, unknown or other
  modified_base (267)..(267): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctnaagaacctattangacaagttgtaccagcagagcaggacngccctgtatgtcatctatggaatctagtaggtaaaacaccggacctgacggactacccagaccgacttctctcggtcctacctactacgacggtaaacacacgtaccttcctacgacctactaccacggtacgggtcctacgaagggccgggaaagtacgtaggacggtcacggtacttaagttaactttagggtaaacggttaccgggggaacgtaaagggtaaagttacgggttaaaacgtttaacggaaggtttagggggtttacggtttaccgggggaacggggtaacgggtaaaccggaacggtaccggtaaccgggtaaccccggttacccggttaaaccggtacccggtaaccgaccccggtaaacgggtcccgtttccccggaccccccggttacgggtccctaacccggtttccgtttacccccggg

SEQ ID NO: 375932 - DNA, 583 bp, Homo sapiens
  misc_feature: GZ8MTXP02F3ECN.2.21.B10.1.454.CMB.2.raw
  modified_base (218)..(218): a, c, t, g, unknown or other
  modified_base (239)..(239): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggngacagcctcagaacctattangcaagttggtaccagcagaagccaggacaggcccctgtaattgcatctatggaatctataggtaaaacaccgcctacgaggactccagaccgatctctgctcctactgacgaaacacagcttacctgaacctatcacgtcggggctacgaggcggaagacgtggagtctaggacttaattagttaggtaacggtccggggtaacaaggtaaacggttgtaaacttacgaggttgggtcggttacgggacgggtaacgggaacctaaggcgtacggaacccgttcgtacgtaccacgacccgaacggtcctacgtcccccgttaggtcctaccgtcgtttccccg

SEQ ID NO: 375933 - DNA, 772 bp, Homo sapiens
  misc_feature: GZ8MTXP02FTI3M.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggagacagcctacaagaacctatatgcaagttgtaccagcagaagcaggacacggcccctagtaattgactatctatggaatctaagtacggtaaaaaccacccggaccctacgtaagggacctacccgaggacctatttacctcgtcggaccttacccttaacgacgtagggaaaccacgtaacgttccctttaccgttacgaacctacttaccgaaccggttcgggggcctacggacgggtaaccgggtaaacgagtacggaaggtcgtacggtaactttaagtttaagttacgggtaaacggggtccgggggtaaacaaaggggttaaacggttaagggttaaaactttacgaaggtttcgggggttacgggtttaccgggggacggggtaaacgggaaaaccggtacggtaccggttaacggtaaacccccggttaccgtaaccggttacccggaaccggttaaacccccggaaacgggttccccggtaaccccggttacccccccggttacgggttacccttaccccgttacccgggtttttaccccccg

SEQ ID NO: 375934 - DNA, 656 bp, Homo sapiens
  misc_feature: GZ8MTXP02FP02V.2.21.B10.1.454.CMB.2.raw
  modified_base (218)..(218): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcagaacctattatgcaagttggtaccagcagaagccaggacaggcccctgtaatgcatctatggaatctaataggtaaaaaccaacccggccctacgaagggactacccaagaccgtattcctctggctccctactcgaggaaaccacagccttccttagaccatcacgtcggggctacgagggccgaagacgtgacgtctagacttaattagttaggtaaacggtcccgggggaataagggaaagttacgggtaaatttacgaaggtttgggtaggtttacggggacgggtaacggggtaacccgaaagggtccttacgggtaaccccgttccgttaaaccgttacccgaaccggttaaccccgaaaacggggtcccttacccggtcccccccttaccggggtaccctaacccgttcccgtttacccccg

SEQ ID NO: 375935 - DNA, 731 bp, Homo sapiens
  misc_feature: GZ8MTXP02F27F4.2.21.B10.1.454.CMB.2.raw
  modified_base (232)..(232): a, c, t, g, unknown or other
  modified_base (260)..(260): a, c, t, g, unknown or other
  modified_base (323)..(323): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggacccctgctgtgtctggtcggtccgttgggacagacagtcgaaggtatcacatcgaccgaaaggganacacgccctacaacgtaaaccttattancgacgtaaaggttacggtacccagacaagaacgccgaaggacgacggcccctagtaatcgtanatctaataggtaatactaagtaacggtaaaaaccacccggcctacgaagggtacctacccgaacgtaccgtacttccgtcgtacggtccttaccctaacgtacgacggtaaacacgtacgttcccttaccgtacgacctactaccgtacggtacgggtcctacggaggggaccggaaagagtacggacgggtactagtaacgttaagtttaagttaggtaaaccggggtaccgggaacgtaaagggtaagttaggttaaacttacgtaaggtttcgggtacggttacggggacggggaaaacgggtaccgaaggtaccgtacgggtaacccgttaccgtaccgtaccgaacgtacccgaaaggtccgtacccggtcccccgtcggtaccctccttaccggtttccccc

SEQ ID NO: 375936 - DNA, 589 bp, Homo sapiens
  misc_feature: GZ8MTXP02IYVZZ.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaacctattatgcaagttgtaccagacagaagccaggacacggcccctagtaatgtacatctatgaatactagtaagaaaaccaacccgccctacgacggactccagaccgattctctgctcctactcaggaaacacacgcttcctagaccatcagtcgggctacgacggacgaagcgtaggacgctagtacttaattacgttaggtaacggtccgggaacaaggtaagtacggttaaattaacgtagttagggtcggtttacgggacgggtaacgggaccgaagtccgtacggtacccgtacgtacgtacgacgaccgaaggccctcgtacccccgtcggtacctacgttccgttacccg

SEQ ID NO: 375937 - DNA, 617 bp, Homo sapiens
  misc_feature: GZ8MTXP02J1FS9.2.21.B10.1.454.CMB.2.raw
tcagacgctcgacacacgaccggtgctcgatttagtgtcgtcgcaagagggaggggggctcagaagcagagttctggggtgtctccaccatggcctggaccccctctctggctcactctcctcactctttgcataggttctgtggtttcttctgagctgactcaggaccctgctgtgtctgtggccttggacagacagtcaggatcacatgccaaggagacagcctcagaacctattatgcaagttggtaccagcagaagccaggacaggcccctgtaattgtcatctatggaatctatacggtaaaaacaccggcctacgagggactacccgagaccgtattctctggcctcctactcaggaaaccacacgtcttccttagaccctatccaacgtggggcctacgagggcggaaagtataggaagggtcctaggtaaccttagtttaagtttagggaacgggttccgggggaaactagggtaaagttaggtaaactttacgagttgggttacggttcggggacgggaacgggccgaaaaggcctaggtaaccccgtctacggtacaccggtacccgaaggcctaccggccccctaagtccggtaccacgtttcccg

SEQ ID NO: 375938 - DNA, 894 bp, Homo sapiens
  misc_feature: GZ8MTXP02GZ9PI.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgttggtttcttctgagctgactcaggaccctgctgtgtctgtggccttgggacagacagtcaggatcacatgaccgaaaggagacagcctacaacgaaccttattatcgactaaaggttggtaaccagacaagaacgccgaaggacacggcccctagtaattgtacatctagtgaatacgtagtaaggtaaaaaccaacccggtccctacgaacgggaactacccgaacgaccgtaacttctccgtcggtacctacctactaaccgtacgggaaaacctaacgtaccgtacctttcccgttacgaaccctaagtacccgtaacggttacgggggacccttacggaaacggggtaacccggtaaaaggacgttaacggggaacggtacgttacggtaaacctttaaagttttaaagtttaaacgggttaaaaccggggttacccgggggtaaaaccgtaaacggggttaaaacgggtttaacggggttttaaaaagtttaaccggttaaagggtttcgggggtttacggggttttaaccgggggaacccgggggtttaaaacgggggaaaacccggtaaaacgggttacccggtttaaccggggaaacccccgggttttaccccgtaaaacccgggtttacccggtaaaacccgggtacccccgaaaaccggggttccccgtaacccccgggttacccccccggttaccgggggtttaccccttaaccccggtttaccccggttttacccccccgg

SEQ ID NO: 375939 - DNA, 575 bp, Homo sapiens
  misc_feature: GZ8MTXP02I5Z0M.2.21.B10.1.454.CMB.2.raw
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaatgtcatctatggaatctataggtaaaaacaccggcctacaggactcccagaccgattctctggctcctactcaggaacacagccttccttagaccatccactggggctcgaggcgaaagacgtgaggtctagaacttaattacgttaggtaacggttccggggaacaggtaaagtaggtaaattacgagttagggtgtttaccggggacggtaacgggacccaaggtcgtcggaaaccgttccgtacgtcgacgtacccgaaggcctacgcccccgtcggtccaacgtccttacccg

SEQ ID NO: 375940 - DNA, 640 bp, Homo sapiens
  misc_feature: GZ8MTXP02FJ6KK.2.21.B10.1.454.CMB.2.raw
  modified_base (431)..(431): a, c, t, g, unknown or other
  modified_base (472)..(472): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgttgtgtctgtggccttgggacagacagtcaggatcacatgaccaaaggagacagcctcagaacctatatgactaagtggtaccagcaagaagccaggacacggcccctagtaattgtcatctatggaatctaagtaaggtaaaaaccaaccggaccctacgaaggggactacccagaccgtattccctcgtgctacctactacaaggaaccacagtccttaccttagaaccataccacgtggggcctcgaggacggaagangaggctagaacttattagttaggtaaaggtccgggggtaanagggtaaacggttaggtaaaatttacgtaagttcggggttaggtacggggacggtaacgggggaacccaaaggtctacgggtaacccgtaccgttaaccggaccgacggaaccccgaaggtccgtacccgcccccgtacggtccctacctcccgttaccgttcccccc

SEQ ID NO: 375941 - DNA, 660 bp, Homo sapiens
  misc_feature: GZ8MTXP02F3VY2.2.21.B10.1.454.CMB.2.raw
  modified_base (349)..(349): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagaacctattatgacaagttggtaccagcagaagccgaaggacacggcccctagtaattgtcatctatggaatctaataggtaaaaacaccggcctacgaggactccagaccgacttcncgtgctctactacaggaaacacagtccttccgtacgacctatccacgtcgggctacgagggtaccggaaagagtaggaacggtcgtacgtacttaaagtttaacgttagggtaaacgggtccgggggtaactaagggtaaacgttaggttaaagttacgtaaggttgggttagttacgggggtacgggaacgggtaacccgtaaaggcgtacggtaacccgtaccggtaaccgttaccgaaccgtaacccggaaacggtcccgtcccggtacccccgttaccggtaccgtaacccgttaccgtttcccccg

SEQ ID NO: 375942 - DNA, 708 bp, Homo sapiens
  misc_feature: GZ8MTXP02JCZ78.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacagaacctattatgacaagttggtaccagcagagcaggacaggacccctgtaactgtcatctatgaatctaagtagtaaaaacaacccggaccctacgacgggactacccgacgaccgtacttctcgtcggtaccttcctactacgacgggaaacaccgtacgtaccttccgttacgaaccctactaccgtaaccggtcggggtacctaccggaagggacccgggaaagagtagggacggtcgtagtacgttaaatttacggttaggtaaacgggttaccgggggaaacgtaagggtaaagttaagggttaaacttaacgtagtttggggttacgttacggggtacggggaacggggtaacgaaacggtccgtaacggtaacccggttaccgtaacccggttaccgaaaccgacccggtaaacggtccgtcccggtacccccggttacggtacccgtaaccgttcccgtttacccccggg

SEQ ID NO: 375943 - DNA, 633 bp, Homo sapiens
  misc_feature: GZ8MTXP02GDVRD.2.21.B10.1.454.CMB.2.raw
  modified_base (297)..(297): a, c, t, g, unknown or other
  modified_base (314)..(314): a, c, t, g, unknown or other
  modified_base (368)..(368): a, c, t, g, unknown or other
  modified_base (445)..(445): a, c, t, g, unknown or other
tcagacgctcgacacacgaccggtgctcgatttagtgtcgtcgcaagagagagaggtgccttagccctgaattccaaggcatttccacttggtgatcagcactgaacacagaggactcaccatggagttggggctgtgctgggttttccttgttgctattttagaaggtgtcagtgtgaggtgcagctgggtggagtcgtggggggagcttgggtacagccgtgggagggtccctggagactctcctgtgcagcctctggattcaccttcagtagttatagaaatgaacgtggtccncgagctcgagggagggntggtagtggtttcatactattacgtagtagtggtactacatatatacgcagctntgtaggacggtcatccactatcctacgagaacgaccaaccgaccaagaacctactactagtaactactaaactaaanacgtaaacacgaccgtagaacgaacggaccggaacggaaaccgaccggttacgttaggttttaacttaccgttaggtacggtaacggaaaggtaaacgttaaaaccgtttacgttaaggtttttaggaaggtttaaggtttaacttaacgtaacccggtacccccgggtaccgttacggtaaacccgg

SEQ ID NO: 375944 - DNA, 613 bp, Homo sapiens
  misc_feature: GZ8MTXP02FF51L.2.21.B10.1.454.CMB.2.raw
  modified_base (226)..(226): a, c, t, g, unknown or other
tcagacgctcgacacacgaccggtgctcgatttagtgtcgtcgcaagaggggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgcaaggagacagcctnaagaacctattatgacaagttggtaccagcagaagcaggacaggcccctgtaatgtcatctatgaatctaataggtaaaaaccaccggcctcgagggtactaccgagaccgtattctcgtggcctactactacgaggaaacacagtccttcctagaaccctataccacgttcgggggactcgagggacgaaagatggaaggtctaggaacttagtattacggtaacgggtccgggggaactaggggtaaacgtgggttaaaacttacgtagttacgggtggttcggggacgggtaacgggactaacggcttacggaacccgttcgtaaccgtcacggaccctaaagggcccttaccggcccccgttaggtccaaccgttcgttcccg

SEQ ID NO: 375945 - DNA, 686 bp, Homo sapiens
  misc_feature: GZ8MTXP02I1EOK.2.21.B10.1.454.CMB.2.raw
  modified_base (426)..(426): a, c, t, g, unknown or other
tcagacgctcgacacacgaccggtgctcgatttagtgtcgtcgcaagagggaggggggctcagaaacagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggacgacagcctacaagtaacctattatagacctaaggttcggtaccagcaagaacgaccgaggacacggcccctagtaacttcgtacatactagtaggaattactaacgtaacggttaaaaaaccgacccggtaccctacgaacgggtacctacccgaacgaccgtacttcccgtaccgtcggtcctacctactaccgaacggaaccnctaacgtccctttacctacgacctacgtacacgtcgggctacggaggacggtaagagtaggacggtcgtagtactagtttacgttacggttaacggtaccggggtataaggtaaggttagtaagttacggagttagggttcggttacgggacggggtacgggaaccgtaggacctacgggtaccgtaccgtaccggtcgaccgtaccggaacgtccgcccggtcccctacggtccctaccgttccgttcccgtttccccg

SEQ ID NO: 375946 - DNA, 623 bp, Homo sapiens
  misc_feature: GZ8MTXP02FURSG.2.21.B10.1.454.CMB.2.raw
  modified_base (337)..(337): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagccctacagtaacctattatgcaaggttggtaccagcagaagccaggacacggcccctagtaatgtcatctatgatctatagtaaaacaccgcctacaggactccagacgatcnctcgctcctactcagaacacgacgtccttcctagacctataccgacgtcgggtctcgaagggtaccggagagtaggacggtctaggacttaagttacgttaggtaacgggttaccggggaacgtagggtaaaggttacggtaaatttacgtaaaggttgggttaggttacggggagggaaacgggtaacgaacggtcgtacggaacccgttaccgtaaccgtacggacgtacccgaacgggtccctaccggtcccccgtacggtacctaccggttcccttccccgg

SEQ ID NO: 375947 - DNA, 910 bp, Homo sapiens
  misc_feature: GZ8MTXP02GRWI5.2.21.B10.1.454.CMB.2.raw
  modified_base (220)..(220): a, c, t, g, unknown or other
  modified_base (242)..(242): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctacaagaacctattangacaagttgtaccagcagaacgcgaggacacggcccctagtaatgtacatctagtaggaatctaagtaacggtaaaaaaccacccggaccctacggaacgggaactacccgaacggtaaccgtaacgtttcctaccgtacggtacctacccttaaccgttacgaaacgggaaaaccaaccgtaacggttaccccttttaccgtaaacggtaaccctaacgttacccgaaaccggtttcgggggacccttaaccggtacggggaaccggggaaaagtacggttagggaaacgggtcgttaaacggtaacctttaaaacgttttaaggtttaaacggggttaaaaccgggggttacccggggggtaaaacctaaaacgggggttaaaaacgggtttaaacggggtttaaaacgtttaaacgggttaaggggtttacgggggtttacggggtttaacccggggggaaccgggggaaaaccgggggttaaaaccccggaaaaacggggtttccccggttaaaccgggtaaacccccgggtttaccccggtttaaaccggtaaccccggtaaacccgggtaacccccgaaaaccggggtcccccgtttaacccccgggcccccccggttacccgggttacccctaacccggtttcccgttttaacccccccgg

SEQ ID NO: 375948 - DNA, 739 bp, Homo sapiens
  misc_feature: GZ8MTXP02JJ0EI.2.21.B10.1.454.CMB.2.raw
  modified_base (246)..(246): a, c, t, g, unknown or other
tcagacgctcgacacacgaccggtgctcgatttagtgtcgtcgcaagagggagggggctcagaagcagagttctggggtgtctccaccatggcctggaccccctctctggctcactctcctcactctttgcataggttctgtggtttcttctgagctgactcaggaccctgctgtgtctggtggccttgggacagacagtcaggatcacatgaccaaggagacagcctacaacgtaaccttattangactaaggttcggtaccagacaagaacgaccgaggacacggcccctagtaatcgtactatctagtaggaactacgtaagtaacggtaaaaaccacccggtacccttacggaacggtacctacccgaacgtaaccgtactttacctacgtcggtaccttaccgtacctaacgtaacggaaaacctaaaccgtacgttaccctttaccgttaccgaaacccttaacgtacccgtaacggttaccggggaccgttacgggaaacgggaccggtaaaaggtcgtaacggacgggtactagtacttaagttaagttacggtaacgggtaccgggaagtaagggtaaacgtaaggttaaacgtagtaggtacgggttacggttacggggacgaagggtaaccgtaggacgtaccggacccggttaccttaccggaacgtccggaaccgaacggtacccgtcccggtaccccgtcggtacctaccggttcctttaccccg

SEQ ID NO: 375949 - DNA, 656 bp, Homo sapiens
  misc_feature: GZ8MTXP02IL3KO.2.21.B10.1.454.CMB.2.raw
  modified_base (222)..(222): a, c, t, g, unknown or other
  modified_base (232)..(232): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggttttcttctgagctgactcaggaccctgctgtgtctggtggccttgggacagacagtcaggatcacatgaccaaagganacagccctanaagaaccttattatgactaaggttcggaaccagacaagaacgccgaaggaccacggccctagtaatgtacatctagtagaatactaagtaacggtaaaaaccacccggtcctacgacgggtactacccgaagtaccgtacttacctcgtcgaccttacctactacgaacgtaaacacacgtaccttcctagacctactacgacgttcggacacggaaggacgaagagtagacgggtactagaactttaaattacgttaacgtaacgggtacggaacgtaaggtaaaggtacggttaatacgtaaggttgggtacgttacgggacgggaaacggtacgaacggtccgtacgtacccggttaccgtacgtaccgaacggacccgaacggtctacccggtccccgtggtaccctacgtccgtccccg

SEQ ID NO: 375950 - DNA, 677 bp, Homo sapiens
  misc_feature: GZ8MTXP02JVA6N.2.21.B10.1.454.CMB.2.raw
  modified_base (299)..(299): a, c, t, g, unknown or other
tcagacgctcgacacacgaccggtgctcgatttagtgtcgtcgcaagagagagaggtgccttagccctgaattccaaggcatttccacttggtgatcagcactgaacacagaggactcaccatggagttggggctgtgctgggttttccttgttgcttattttagaaggtgtccagtgtgaggtgcagctgggtggagtcgtggggggaggcttgggtacaggcctgggagggtccctgagactctcctgtgcagcctctggattccaccttcagtattatagaaatgaactgggtccnccaggcctcgaggggaagggctagggagtgggtttcatacattactagtagtggtacgtacatatattacgcagctctggtagaagggcctattccacctatcctaccagacaaccaaccgcccaagaactcactgtaactctaaacaaatcgaaacacgacccgtaggaacgacggaacccgggaagggaaccgaccggggtacctttaggttttaaactttaccggttaggtacggtaacggggaaacggttaaaaccggttaaaaacgttttaccggtttaaggtttttttcgggggaaggttttaggggttttaaacgtttaccgttaaaccccggtaccccccgggggttaaaccctttacggtaaacccggg

SEQ ID NO: 375951 - DNA, 731 bp, Homo sapiens
  misc_feature: GZ8MTXP02F3E2S.2.21.B10.1.454.CMB.2.raw
  modified_base (352)..(352): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcaacatgaccaaaggagacacgcctacaagtaacctattatcgactaaaggtttacggaccagacaagaacgccgaaggacacggcccctagtaactgtacatctataggaatactaagtaacgtaaaacaccgcctagacggacnccagaccgtattcgtctcgtcctacctactacacggaaaccacgtacgtaccttccttacgaaccgtactaccgacgttcggactacggaacggacggtaaagcgtaggacggtactaacggtaactttaagtttaacggtttaacgggttaaaccgggtaccgggggtaaacgaaaacggggttaaaggttaaaccggtttaaagttaaacgtacggtttagggggtttacgggttacgggggaaccgggtaaacggggaaaacccgttaacggtaacggtaccggtaaacccgttaccgttaccggaacgacccgtaacccggaacgtacccgtcccgtacccccggtcgttaccgtacccgtttcgttaacccccg

SEQ ID NO: 375952 - DNA, 944 bp, Homo sapiens
  misc_feature: GZ8MTXP02HZY3I.2.21.B10.1.454.CMB.2.raw
  modified_base (225)..(225): a, c, t, g, unknown or other
tcagacgctcgacacacgaccggtgctcgatttagtgtcgtcgcaagagggagggggctcagaagcagagttctggggtgtctccaccatggcctggaccccctctctggctcactctcctcactctttgcataggttctgtggttttcttctgagctgactcaggaccctgctgtgtctggtggccttgggacagacagtcaaggatcaacatgaccaaagganacagcctacaagtaactattatgactaagttgaccagacaagaacgccgaaggaccacgggtaccccctaggtaaactttcggtactaacgttaccgttaagttagggaaaactttacttaaaacggttaaaacgggttaaaaaaaaaccccgaaacccggggtaccccctttaacggaaacggggtaaacccttaccccccgaaaggtaaccccgttaacctttaccgtttaccgttaacgggcctttaaccccttaaacgttacccgaacgggtaaaaaccaccgtaaacgtccctttaccgtttaacgaaaccctaacttacccgaacggtaccgggggtaccttacccgggaaagggggttaaccggaaaaacgggttggtaacgggaaaccgggttacccgtaaagggttaaaaccttttaaaggtttaaacggttttaaaccggggttaaaaccgggggttaaacccgggaaacgttaaaacgggggttaaacgggtttaaacgggtttaaaaacgttaacggtaacggggtttaggggttaccggggtttaaccgggggaaaacggggtaaacccgggtaaaaccggaaaaccggttcggtaaacccggtaaacccggttcccgttaccgaaacgttacccgaacggaaccgtccccggtaacccgtcccccggtacgttacccccgttaacgttcccggtttaccccccgg

SEQ ID NO: 375953 - DNA, 684 bp, Homo sapiens
  misc_feature: GZ8MTXP02IWWH4.2.21.B10.1.454.CMB.2.raw
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcgaggaccctgctgtgtctggtggccttgggacagacagtcaggatcaacagtcgaccgaaaggagaacacgccctacgaacgtaaaccttattatcgactaaggttcggtaccagacaagaacgacaggacacggccctagtaatcgtacatactataggaatactaagtaacggtaaaaaccacccggtacctacgaacggacctacccgaagtaccgtacttctacgtcggtaccttacctaactacgaacgaaccactaacgtcccttacgtacgaacctactaccgtacgtcgggactacggaggacgtaaagcgtaggacgtagtacgtaatttagttaagttaggtaacgggttaccggaataaagggtaagttaaaggttaacttagtagggttaggttacggttacgggacgggtaacggtaacgaggtaccgtaccgaccgttacgtacggaacctacggacccgtaacggcccgtacccgccccggtacgtaccctacgttccttaccccgg

SEQ ID NO: 375954 - DNA, 783 bp, Homo sapiens
  misc_feature: GZ8MTXP02IO12I.2.21.B10.1.454.CMB.2.raw
  modified_base (220)..(220): a, c, t, g, unknown or other
  modified_base (243)..(243): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctcaacgaaccttattangactaagttcggtaccagacgaagaacgcgaaggacgacggcccctagtaactcgtactatctaagtaggaactactagtaaacggtaaaaccgaacccggtcctacggacggtacctacccgaacgtaccgtacttccgtcgtacggtaccttccctaacgtaccgaaggtaaaccctacgtaaccggttaccctttaccccgttaacggaacccttaactacccggtaacgggtacggggtacctaccggggtaaacgggaaccgggtaaaaggtacggttaaacgggacgggtacgtacggttaaaccgtttaaagtttaacggtttaacgggttaaacggggtacccggggtaaacggttaaagggtaaacgggtttaaacggttaaacgttaaaccggtggtttaagggttacgggtttaccgggggaaggggtaaccgggtaacgtacgtacgtacggtaccgtaccgtacgtacccgacggacccgaacgtcgtacccggtacccccgtaggtaccctaccgttcttaccccg

SEQ ID NO: 375955 - DNA, 639 bp, Homo sapiens
  misc_feature: GZ8MTXP02FPKQ7.2.21.B10.1.454.CMB.2.raw
  modified_base (442)..(442): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaggagacacgcctacaacgtaacctattatgactaagttggtaccagcaagaacgccgaggacacggcccctagtaactgtcatctatggaatctaagtacggtaaaaaccacccggccctacgaacggactcccgaacgaccgtacttccgtctcggtcctacctaactcacggaaaccactacgccttcctacgaccactcacgtggctacgaggacggaaagngtaggacgtctagacgttaagttaacgttagggtaaacggtccgggaataagggaagttacggttaaatagtagttacgggtagggttcggacgggtacgggaacctaggccgtaacggacccgttaccgaccgtacgacggaacccgaacggtaccgtcccggcccccgttacggtacacccgtttcgttaccccg

SEQ ID NO: 375956 - DNA, 659 bp, Homo sapiens
  misc_feature: GZ8MTXP02IYBMK.2.21.B10.1.454.CMB.2.raw
  modified_base (283)..(283): a, c, t, g, unknown or other
  modified_base (315)..(315): a, c, t, g, unknown or other
tcagacgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaacctattatgcaagttggtaccagcagaagccaggacaggcccctgtaattgnatctatgaatctatacgtaaaacaccggcctnacggatcccagaccacttctctcgcctcctactacgacgaaaccacacgtccttaccttacgaaccctaactccgtaacgtcgggggtaccctacgaacggggacgaaacgagtcggaacgggctacggtaacttaagtttacgtttagggtaaacggttacccgggggaactaagggtaaagtacggttaaattaacgtagtttagggtaggtttacgggacggggaacgggtaaccgaaggtaccgtacggtaaccccgttaccgtaccggtaccgaaccggaccccgaacggggtccctccggtacccccccgttggtaccctacctttacccgttccccg

SEQ ID NO: 375957 - DNA, 639 bp, Homo sapiens
  misc_feature: GZ8MTXP02F2HEK.2.21.B10.1.454.CMB.2.raw
  modified_base (461)..(461): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccgaaggagacacgcctacaacgtaaaccttattatgacgtaaggttacggtaccagcaagaagaccgaggacgacgccctagtatgactatctagtagaatactaagtaacgtaaaaccgacccgacctaggtaacggacctaccgaacgtaccgtaacttccgacgtacgtcctacctacacgacgtaacactacgttctctacgactactcgcgtacggactacgaggacgtagcgtaggacgtntacgtaacttaagtttacgtaacggttacggtacggaactagggtaacgtagtaagttacgtaggtaggttcggtacggacggaacggacgaagtccgtaccggacccgttacgacgtaccgacgtacccggaacgtcccgtcccgtacccccgtggtacctcccgtcgtttcccccg

SEQ ID NO: 375958 - DNA, 703 bp, Homo sapiens
  misc_feature: GZ8MTXP02IU9HE.2.21.B10.1.454.CMB.2.raw
  modified_base (231)..(231): a, c, t, g, unknown or other
  modified_base (318)..(318): a, c, t, g, unknown or other
tcagacgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccgaaggagacagccctnaaacgtaaccttattactagacgtaaggttacggtaccaagcaaggaagccgaaggacaccggtcccctagtaattgtcatctaagnggtaacttacgtaagtaacggtaaaacgtacccggccttagaacgggtactaccgagtaccgtagtacctcgtcgccttacctaccgttaacgagaaaccactaacgtcccttaaccgtgaccctataccgagtacggggactacggaggtaggaaacgtagtacggacggtactacgtaacttagtttaaacgtttacggggaaaacgggttcgggaaaactagggtaaaacggtacgttaaaattacggtaagtaccgggttaggttccggggaaacgggtaacgggaacgtagtaccgtacggtaaccgttaccgtaacggactacggacccgtaagcccgttacgacccccgtaggttacccaccgtttccgtttacccgg

SEQ ID NO: 375959 - DNA, 862 bp, Homo sapiens
  misc_feature: GZ8MTXP02IN7RI.2.21.B10.1.454.CMB.2.raw
  modified_base (250)..(250): a, c, t, g, unknown or other
  modified_base (281)..(281): a, c, t, g, unknown or other
  modified_base (310)..(310): a, c, t, g, unknown or other
  modified_base (314)..(314): a, c, t, g, unknown or other
tcagacgctcgacacacgaccggtgctcgatttagtgtcgtcgcaagagggaggggggctcagaagcagagttctgggggtgtctccaccatggcctggaccccctctctggctcactctcctcactctttgcataggttctgttggttttcttctgagctgactcaggaccctgctgtgtctggtggccttgggacagacagtcaggatcacatgaccaaaggagacagcctacaacgaaccttattanagacgtaaaggttcggaaccagacaggaacnccgaggaccacggccctagtaatgtcatntaanggtaactactaagtaaacgtaaaaccaccggtccctagacgggacctacccggagaccgtacttccgtacgtcggtaccttaccgttaacctacgaaccggtaaaactaccgtaacgttaccccttttacccgtaactaaaccccgtacttacccgggtaaaccgggttcgggggtaacccttcggggaaacggggtaacccggggtaaaacgtagggtttacggggaaccggtaccgtttaaacgtaacccgttttaaaagtttttacggttaaacgggggttaaaacccgggggttacccgggggaaacgttaaaagggggttaaaggtttaaacggggtttaaatttaacggtacggggtttagggggtttacgggttaccgggggaaacgggggttaaaccggggaaccttaaacgggggtcccgttaaacccgggttaaaccccggttacccgttaccggggaacctaacccgggacccggtaagggtccctaccccggttcccccgtaccggtacccttaccgtttccccgtttacccccgg

SEQ ID NO: 375960 - DNA, 515 bp, Homo sapiens
  misc_feature: GZ8MTXP01AILFT.10.72.G06.1.454.CMB.2.raw
  modified_base (256)..(256): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtcncctggtaccaacaacacccaggccaggcccccagactcatcatttctgatgtcagtgatcggccctttgggactttctaatcgcttctctgcctccaagtctggcaacacggcttctctcgaccatcctccgggctccacgctgaggacaggctcgattattacctggcagctcatatacaccacgggcgaactcttcgtgagtagtcggttcggcgggaccgtggtcgtcgtaccgtccgttacgttcgcgaacccgg

SEQ ID NO: 375961 - DNA, 510 bp, Homo sapiens
  misc_feature: GZ8MTXP01EU80F.10.72.G06.1.454.CMB.2.raw
  modified_base (254)..(254): a, c, t, g, unknown or other
  modified_base (311)..(311): a, c, t, g, unknown or other
tcagcatagtagtgcacgaccggtgctcgatttagctacgactgcaagggaaaggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtcncctggtaccaacaacacccaggccaggcccccagactcatcatttctgatgtcagtnatcggccctttgggatttctaatcgcttctctgcctcaagtctggcaacacgcttccctgaccatctccggctccacgctgagacgagctcattatactgcagctcatatactaccacggcgctaactcgttcgtattagtcgtcgggacgggacgttcgcgtcgtaaccgtccgtacgttacgtaacgccgaacccgg

SEQ ID NO: 375962 - DNA, 502 bp, Homo sapiens
  misc_feature: GZ8MTXP01DJAWA.10.72.G06.1.454.CMB.2.raw
  modified_base (467)..(467): a, c, t, g, unknown or other
tcagcatagtagtgcacgaccggtgctcgatttagctacgactgcaagggaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcacacggcttccctgaccatctccgggctccacgctgagacgaggctcattattactgcagctcatatacaccaggggcacgtctcgttgattagttcggcggaagggccnggcttgaaccggtcctacgttcaacgcccgaacgg

SEQ ID NO: 375963 - DNA, 501 bp, Homo sapiens
  misc_feature: GZ8MTXP01C2F8T.10.72.G06.1.454.CMB.2.raw
  modified_base (425)..(425): a, c, t, g, unknown or other
  modified_base (491)..(491): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgtcttctctgcctcaagtctggcaacacggcttccctgaccatctccgggctccacgctgaggacgaggctcattatactgcagctnatactacacccagggcactctcgttgattagttcggcggaggccttggctgaaccgtctacgttcncgcccaacgg

SEQ ID NO: 375964 - DNA, 502 bp, Homo sapiens
  misc_feature: GZ8MTXP01D05NA.10.72.G06.1.454.CMB.2.raw
  modified_base (459)..(459): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacacccaggccaggcccccagactcatcatttctgatgtcagtgatcggccctttgggactttctaatcgcttctctgcctcaaagtctggcaacacggcttccctgaccatctccggctccacgctgaggacaggctcattatactgcagctcatactacacccagggcactctcgttgattagttcggnggacgggcttgggctgaaccgtctacgttcaacgcccgaacgg

SEQ ID NO: 375965 - DNA, 539 bp, Homo sapiens
  misc_feature: GZ8MTXP01BVDUO.10.72.G06.1.454.CMB.2.raw
  modified_base (358)..(358): a, c, t, g, unknown or other
  modified_base (376)..(376): a, c, t, g, unknown or other
tcagcatagtagtgcacgaccggtgctcgatttagctacgactgcaaggggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggcccaggcccccagactcatcatttctgatgtcagtgatcggccctttggactttctatcgcttctctgcctcaagtcnggacaacacgtcttcccngaccatctccgggctccgacgcgtgacgacgaggctcgtagttattacgtgcagtctcatactaccaccgagggcctacgtctcgttgtaattgttccgggcgggttacgggccgttgggtcctcggtaacccgttccgtacggttccaacgcccgaaccggg

SEQ ID NO: 375966 - DNA, 540 bp, Homo sapiens
  misc_feature: GZ8MTXP01EJCTH.10.72.G06.1.454.CMB.2.raw
  modified_base (255)..(255): a, c, t, g, unknown or other
  modified_base (307)..(307): a, c, t, g, unknown or other
  modified_base (372)..(372): a, c, t, g, unknown or other
  modified_base (495)..(495): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtcncctggtaaccaaacaaacacccacggccacggcccccagactcatcatttcngtatgtcagtgatcggcctttgggtactttctaatcgtcttctctgcctcaaagtctggcaaacncggcttccctgacctagtctccgggctaccgaacgtcgtgaggacgacggtctactaatttacttaactgacagctacattaacaccgaccgagggccacgtcctgttagtagttagtcgggnggacgggccttggctacgaaccgtctacgctaacgccgtaaccgg

SEQ ID NO: 375967 - DNA, 559 bp, Homo sapiens
  misc_feature: GZ8MTXP01BPGJN.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgtcttctctgcctccaagtctggcacacggcttccctgaccatctccgggctcctacgctgaggacgaggctcattattactgcagctcatactacctacccgaaggggccaacctctccggttagtattacgtttccgggcgggttacgggacccgttcgggtccgtacggtaaccccggttcccgtaaccggttccctaaccggccccgtaacccgggg

SEQ ID NO: 375968 - DNA, 501 bp, Homo sapiens
  misc_feature: GZ8MTXP01DY5RQ.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcaggacacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttggactttctaatcgcttctctgcctcaagtctggcaacacggcttccctgaccatctccgggctccacgctgagcgaggctcattattactgcagctcatactacacccgagggccactctcgttgattagtcggcggaggccttggctgcccgtctacgttcaacgcccgtaacgg

SEQ ID NO: 375969 - DNA, 510 bp, Homo sapiens
  misc_feature: GZ8MTXP01BP7SO.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggccccagactcatcatttctgatgtcagtgatcggcctttgggactttctaatcgtcttctctgcctcaagtctggcaacacggcttccctgaccatctccgggctccacgctgaggacgaggctctagttattactgcagctcatactacacccgagggcactctcgttgacttgttcggcggacgggccttggctcgaaccgtcctacgttccaacgcccgaacgg

SEQ ID NO: 375970 - DNA, 596 bp, Homo sapiens
  misc_feature: GZ8MTXP01DS9DG.10.72.G06.1.454.CMB.2.raw
  modified_base (255)..(255): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactgcaccagcagtgacataggtgtcttataactatntctcctaggtaaccaacaaaccacccgacgccgaccggccccagactcatctatttctgatgtcagtgactcggtccgttggtactttctatcgtcttctctcgtcctctaagttctcggaccaactacgggtccttccctcgtacctacgtccgtccgggtccctaccacgtcgaggaacggacgaacggtcttactaagtttaactttcgtacgcgactctcaattactaacccgtaccgagggtctactcgtcgttgtaattcggttcgggacgggttacgggcttcgggtccgtccgtaacccgtaccgtaccggttactaaccggcccgtaaccgg

SEQ ID NO: 375971 - DNA, 503 bp, Homo sapiens
  misc_feature: GZ8MTXP01BGKLP.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgcttctctgcctccaagtctggcaacacggcttccctgaccatctccgggctccacgctgaggacgaggctcattattactgcagctcatatacaccagggcactctcgttgattagtcggcggagggccttgggctggaaccgtcctacgttcaagcccgaacgg

SEQ ID NO: 375972 - DNA, 569 bp, Homo sapiens
  misc_feature: GZ8MTXP01DW3UE.10.72.G06.1.454.CMB.2.raw
  modified_base (304)..(304): a, c, t, g, unknown or other
  modified_base (453)..(453): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctgtaccaaacaacacccaggccaagcccccagactcatcatttcngatgtcagtgactcggtccctttggtactttctaatcgtcttctctgccctccaaagtctggaccaacgacggtccttccctgaccctatccgtccgggcttcccgacgtctaggacggacgacggtctactacgtttattactgacanctacaataactaaccgtacccgaggggtcctactcttcgttcgtattacggttcgggcgggacgggttccttcgggctacggaacccgttcctacggttcaaccgcccgtaaccgg

SEQ ID NO: 375973 - DNA, 508 bp, Homo sapiens
  misc_feature: GZ8MTXP01ETWR2.10.72.G06.1.454.CMB.2.raw
  modified_base (496)..(496): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgcttctctgcctccaagtctggcaacacggcttccctgaccatctccgggctccacgctgaggacgaggctcattattactgcagctcatatacacccagggcactctcgttgattagttcggcggagggccttggctgaacccgtcctacggttcncgcccgaacggg

SEQ ID NO: 375974 - DNA, 504 bp, Homo sapiens
  misc_feature: GZ8MTXP01EM29N.10.72.G06.1.454.CMB.2.raw
  modified_base (382)..(382): a, c, t, g, unknown or other
  modified_base (421)..(421): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggtccctttgggactttctaatcgtcttctctgcctcaagtctggcaacacgcttccctgaccatcnccgggctccacgctcgagacgagctcagttattactgcngctcatactacaccgtagggcactctcgttgacttgtcggcggacggcttggctcgccgtctacgttcaacgttcccgaacgg

SEQ ID NO: 375975 - DNA, 517 bp, Homo sapiens
  misc_feature: GZ8MTXP01AO1KW.10.72.G06.1.454.CMB.2.raw
  modified_base (485)..(485): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggcaccagcagtgacatagggtgcttataactatgtctcctggtaccaacaacacccaggccacggcccccagactcatcatttctgatgtcagtgatcggccctttgggacttttctaatcgcttctctgtcctccaaagtctggactaacacggtccttccctgaccatcctccggctccacgctgagacgacggctcagttatactgccagcctcatactacacccgaggggccactctcgttgacttagttcggcgacgggcnggtctcgccgtccgtacgttctcgccgaacgg

SEQ ID NO: 375976 - DNA, 512 bp, Homo sapiens
  misc_feature: GZ8MTXP01D9LNH.10.72.G06.1.454.CMB.2.raw
  modified_base (306)..(306): a, c, t, g, unknown or other
  modified_base (379)..(379): a, c, t, g, unknown or other
  modified_base (453)..(453): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaacgcccccagactcatcatttcngatgtcagtgatcggtccctttggtactttctaatcgtcttctctgcctcaagtctggcaacacggcttcccngaccatcgtccggctccacgctgaggacgagctcattatactgcagctcatactacaccgtagggcactctcgngtattagttcgggcggacggccttggctgaacccgtctacggttcaacgccgtaaccgg

SEQ ID NO: 375977 - DNA, 526 bp, Homo sapiens
  misc_feature: GZ8MTXP01CNQT7.10.72.G06.1.454.CMB.2.raw
  modified_base (377)..(377): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacacccaggccaggccccagactcatcatttctgatgtcagtgatcggccctttgggactttctaatcgtcttctctgcctcaagtctggcaacacgctcctgaccatcnccggctccacgctgaggacgaggctacattacttactgcagctcatactaccaccgaggggcacgtctcggttgtagttacgttcgggcggaacgggccttgggtccgtcggtaacccgtccgtacgttctaaccggcccgtaaccggg

SEQ ID NO: 375978 - DNA, 541 bp, Homo sapiens
  misc_feature: GZ8MTXP01DJV14.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactggccaccagcagtgacataggtgcttataactatgtctctggtaccaacaacacccaggccagcccccagactcatcatttctgatgtcagtgatcggtcctttgggtactttctaatcgtcttctctgcctcaagtctggcaacacggcttccctgaccactcgtccgggctcccacgctgaggacgaggctcgtagtttacttaacgtgacagctacataactaccacccgtagggccacgtctcgttgacgttagttccgggcgggacgggccttcgggctcggaaccccgttcgtaccgttcgtaacgcccgtaaccggg

SEQ ID NO: 375979 - DNA, 506 bp, Homo sapiens
  misc_feature: GZ8MTXP01AWT8E.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgcttctctgcctccaagtctggcaacacgctccctgaccatctccggctccacgctgagacgaggctcattatactgcagctcatactacacccaggggccactctcgttgattacgttcggcggttacgggccttggctgaaccgtctacgttcaacgcccgaacgg

SEQ ID NO: 375980 - DNA, 657 bp, Homo sapiens
  misc_feature: GZ8MTXP01CM608.10.72.G06.1.454.CMB.2.raw
  modified_base (316)..(316): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggcaccagcagtgacataggtgcttataactatgtctcctggtaacccaacaacacccaggccacggcccccagactcatcattctgtatgtcagtnatcggtcctttggtactttctaatcgtcttctctcgtcctctaaagtctcgacaacgacggtcttccctgacccatccgtccgggcctaccgaccgcgtaggacggacgacggtaccttacgtaagtttaactttaacgtcgaccagtacctacctaacttaaccgtaaaccgaaccccggtaagggggtccctaacgttcccgttacggttacggttaaacgttaccggtttaccgggggaccggggttaacggggttacccgttacgggtcccgttaccggtaaccccggttaccccgtaccgggttacccaaccgggttaacccccgtaaacccgggg

SEQ ID NO: 375981 - DNA, 604 bp, Homo sapiens
  misc_feature: GZ8MTXP01DYBT0.10.72.G06.1.454.CMB.2.raw
  modified_base (266)..(266): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggaaccagcagtgattggttggtgttatgacttgtctctggaccaanagcagccaggcgaacgacccccaaattcaatgtatttatgatgtcagtgcgcggcccgtcgggggtcctcgatcgtcttctcgtcggctccgaagtcgtcggaccaaccgtaccggccctccctgaccctattcctcctcggccccttccgacgtcccgtagaggatggaggtcttagggtaatttagttactgttacgtctactagtatcggcgtaagggtccggttacgtcggtttggggttcgggttacgggacggggaacgggtaaccgaacggttcgttacggaacccgtccgtaacgggtccgacggttaccccgaacggttccgtccccgg

SEQ ID NO: 375982 - DNA, 504 bp, Homo sapiens
  misc_feature: GZ8MTXP01ALLKD.10.72.G06.1.454.CMB.2.raw
  modified_base (255)..(255): a, c, t, g, unknown or other
  modified_base (430)..(430): a, c, t, g, unknown or other
  modified_base (493)..(493): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtcncctggtaccaacaacacccaggccaggcccccagactcatcatttctgatgtcagtgatcggccctttgggactttcaatcgcttctctgcctcaagtctggcaacacggcttccctgaccatctccgggctccacgctgacggcgaggctcgattatactgcagctcatatacnccagggcactctcgttgattagttcggcggagggttccttggcctgaacccgtcgtacgttcncgcccgaacgg

SEQ ID NO: 375983 - DNA, 513 bp, Homo sapiens
  misc_feature: GZ8MTXP01D7BAL.10.72.G06.1.454.CMB.2.raw
  modified_base (257)..(257): a, c, t, g, unknown or other
  modified_base (410)..(410): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtcncctggtaccaacaacacccaggcccaggcccccagactcatcatttctgatgtcagtgatcggccctttggactttctaatcgtcttctctgcctcaagtctggcaacgacgtcttccctgaccatctccgggctccacgctgagacgagctnatttatactgcagctcatactacaccgagggcacgtctcgttgacttagtcgggcggacggccgttggcctgtaacccgtcctacgttctaacgcccgaacgg

SEQ ID NO: 375984 - DNA, 566 bp, Homo sapiens
  misc_feature: GZ8MTXP01AI6WF.10.72.G06.1.454.CMB.2.raw
  modified_base (478)..(478): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatctatttctgatgtcagtgatcggcctttgggactttcgtaatcgtcttctctcgtcctccaagtctcggcaacgacggtccttaccctgaccctacgtccgtcccgggcttacccgacgtctggacggacgaggctacaagtttactactgcacgtctacatactacaccgagggcacgtcncgttgtagttacgttccggggcggacggggttcccttgggtcctgaaccccggttcctaacggttccgaaccgttccccgtaaccggg

SEQ ID NO: 375985 - DNA, 561 bp, Homo sapiens
  misc_feature: GZ8MTXP01CYEHS.10.72.G06.1.454.CMB.2.raw
  modified_base (255)..(255): a, c, t, g, unknown or other
  modified_base (303)..(303): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactggcaccagcagtgacataggtgcttataactatgtcncctggtaccaacaacacccaggccaggcccccagactcatctatttcngatgttcagtgatcggtccctttgggactttctaatcgtcttctctgcctccaaagtctggccaacacggccttcctgaccatctcgggctcacgctgagacgaggctctattactagtcgctacgctacactaactaccgacccgacggggcctactaaccgtcgttggtattacgtttaccgggcggggaaacgggttcccgttgggccttcggaacccggttcccgtaccgttacaaccggttccccgaaccggg

SEQ ID NO: 375986 - DNA, 546 bp, Homo sapiens
  misc_feature: GZ8MTXP01B9KCZ.10.72.G06.1.454.CMB.2.raw
  modified_base (305)..(305): a, c, t, g, unknown or other
  modified_base (375)..(375): a, c, t, g, unknown or other
  modified_base (528)..(528): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggcccaggcccccagactcatcatttcngatgtcagtgatcggccctttgggactttctatcgcttctctcgcctcaagtctggcacacggcttcccngaccatctccgggctcccgacgctggacggacgaggctcgtagtttacttactggcagctacatactaccacccgaggggccacgtctcgttgattacggttccgggcgggacgggccgttcgggtcgtcggaacccgttcccgtacgttccnccggttcccgtaaccggg

SEQ ID NO: 375987 - DNA, 541 bp, Homo sapiens
  misc_feature: GZ8MTXP01AGOLH.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatcatttctgatgtcagtgatcggtcctttgggactttctatcgtcttctctcgcctcaagtctggcaacacggtcttccctgaccatccgtccgggctccgacgctgacggacgaggctcaattattactgcagtctcatactaccgtacccgaggggcctacgtctcggttgagttacgttcgggcggttaacgggccttggcctggaacccgttcctacgttctaaccgcccgtaaccggg

SEQ ID NO: 375988 - DNA, 616 bp, Homo sapiens
  misc_feature: GZ8MTXP01A3BPX.10.72.G06.1.454.CMB.2.raw
  modified_base (305)..(305): a, c, t, g, unknown or other
  modified_base (494)..(494): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggcccacggccccagctcatctatttcngtatgtcagtgacgtccggtcccgtttaggtactttactaagtcgtcttctcgtcgtccctacgaacgttcgtacgggaccaacgtacggtcccttacccgtagtacctacgtccgtacccgggtctacccgacgtcgtaggaacggaccgtaacggtcttacgtaaggtttactttacgcgacgtacncctactactactaccgacccggtagggtcctacgtcgtcgttagtacgttcggtaccgggcgggaacgggttccttgggtaaccctcggtaacccgtctacgccgtaaccgcccgtaacggg

SEQ ID NO: 375989 - DNA, 577 bp, Homo sapiens
  misc_feature: GZ8MTXP01CPX2P.10.72.G06.1.454.CMB.2.raw
  modified_base (233)..(233): a, c, t, g, unknown or other
  modified_base (455)..(455): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcactggcacagcagtnacataggtgacttataactatgtctcctggtaccaacaacacccaggccacggccccagactcatctatttctgatgtcagtgtactcggtcctttgggtactttctaatcgtcttctctcgcctctaagtctcggacaacctacgggtcccttccctcgacctactcgtcccgggctccgacgctaggacggacgaggctactatttacttacgtgcgtanctcaatactacgtacccgagggtcctacgtcgtcgttgtacgttcgttacgggcggttaacgggccgttcgggtctccggtaacccgttacccgttacgaccgaaccggccccgtaaccggg

SEQ ID NO: 375990 - DNA, 530 bp, Homo sapiens
  misc_feature: GZ8MTXP01BYS92.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgtcttctctgcctcaagtctggcaacacggcttccctgaccatcgtccgggctccacgtctggaggacgaggctactattattactgcagctcatactaccacccgaggggccacgtctcgttgtacttagtttgggcgggttagggccttgggctcggaacccgtccgtacgttccaacgttcccgaacggg

SEQ ID NO: 375991 - DNA, 506 bp, Homo sapiens
  misc_feature: GZ8MTXP01DRQ0O.10.72.G06.1.454.CMB.2.raw
  modified_base (374)..(374): a, c, t, g, unknown or other
  modified_base (450)..(450): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctggccccagtctgccctgactcagcctgactccgtgtctgggtctcctggacagtcgatcactatctcctgcactggcaccagcagtgacataggtgcttataactatgtctcctggtaccaacaacacccaggccaggccccagactcatcatttctgatgtcagtgatcggccctttgggactttctaatcgtcttctctcgctcaagtctggcaacgacgcttccngacatctcgggctccacgctgaggacgaggctcagttacttactgcagctcatactacaccagggcactctcgttntattgttcggcggaggccttggctgtaaccgtcctacgttcaacgttcccgaacgg

SEQ ID NO: 375992 - DNA, 514 bp, Homo sapiens
  misc_feature: GZ8MTXP01EHC7M.10.72.G06.1.454.CMB.2.raw
  modified_base (378)..(378): a, c, t, g, unknown or other
  modified_base (409)..(409): a, c, t, g, unknown or other
  modified_base (419)..(419): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggccccagactcatcatttctgatgtcagtgatcggccctttgggtactttcgtaatcgtcttctctgcctcaagtctggcaacacgcttcccngaccatctccgggctccacgctgacggacgnggctcagttnttactgcagctcatactacacccgagggcactctcgttgattagtcgggcggacgggacttggcctgccgtcctacggctaacgcccgaaccggg

SEQ ID NO: 375993 - DNA, 570 bp, Homo sapiens
  misc_feature: GZ8MTXP01ELX7X.10.72.G06.1.454.CMB.2.raw
  modified_base (243)..(243): a, c, t, g, unknown or other
  modified_base (306)..(306): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtncttaataactatgtctctggtaccaacaacacccacggcccggccccagactcatctatttcngatgtcagtgatcggtccttgggtatttcctaatcgtcttctctcgccctcaagtctaggccaaaccgcggtccttccctcgtacccactccgtccgggcctccaccgctcgacggacgagctactattacttaactgtacagtcctacatactaaccgacccgaggggtcctacgtctcgtattacgttcgttcgggacgggtacgggaccgttggccgtaacggtacccgttccgtaccgtcgaccgccccgaaggtccccg

SEQ ID NO: 375994 - DNA, 531 bp, Homo sapiens
  misc_feature: GZ8MTXP01AXLER.10.72.G06.1.454.CMB.2.raw
  modified_base (379)..(379): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaaacaacacccaggccacggcccccagactcatcatttctgatgtcagtgatcggtccctttgggactttcgtaatcgtcttctctgcctcaagtctggcaacacgctcccngaccatctccggctccacgctgacgacgaggctctatttactacttgctaagctcatataccacccgagggcacgtctcgttgacttagtcggcgggacgggccgttggccgtcggaacccgtcccgtacgttaccgaacgcccgaaccggg

SEQ ID NO: 375995 - DNA, 698 bp, Homo sapiens
  misc_feature: GZ8MTXP01EJ0IR.10.72.G06.1.454.CMB.2.raw
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcatggcaccagcagtgacataggtgcttaataactatgtctcctggtaaccaacaaccacccacggccacggccccagactcatctatttctgtatgtcagtgactcggtcctttggtactttctaatcgtcttcctctcgtccctactaaacgtcgttacggacctaaacgacgggttcccttacccgtacgtaaccctaacgttcccgtcccggggtcccttaccccgaaccggtccgtacgggaacgggaaccggtaacgggtacctttacgtaacttttaaacgtttaaaccgttggaccctaacggtcccttaacgtaacttaaaccttaaacccgaaccccggtaacgggggtacccttaccgttaacgttaccggttagtaacgttacggttaccggggacgggttacggggttaccttcgggtcctaccggtaacccgttccgtacgttaccgaaccggaacccgtaacccgg

SEQ ID NO: 375996 - DNA, 613 bp, Homo sapiens
  misc_feature: GZ8MTXP01EPS7F.10.72.G06.1.454.CMB.2.raw
  modified_base (242)..(242): a, c, t, g, unknown or other
  modified_base (307)..(307): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcacagcagtgacataggtncttataactatgtctcctggtaaccaacaaacacccaggccacggcccccagactcatcatttcngatgtctagtgactcggcccgtttgggtactttcgtaatcgtcttctctcgtccctctaaagtctacggacaacgcgtccttccctgaaccctcgtccgtcccgggcttacccgacgtccgtaggacggacgaaggtccttactaagtttacttaacgtcgactacgtctactataacctaccgtaacccgaaggggcctacgtcgtccgttgtaattcggtacgggaccgggttaacgggcccgttcggggccttcggtaaccccgttccgttaacccggttcgtaaccggcccccgtaaccggg

SEQ ID NO: 375997 - DNA, 600 bp, Homo sapiens
  misc_feature: GZ8MTXP01BHOH8.10.72.G06.1.454.CMB.2.raw
  modified_base (304)..(304): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggccacagcagtgacagtaggtgcttataactatgtctcctaggtaccaacaacacccaggccacggccccagactcatcatttcngatgtcagtgacgtcggtcctttggtactttctatcgtcttctctcgccctctaagtctcggaccaacgacgtccttccctgaccctactccgtcccgggccttcccgacgcgtacggacggacgacggtctacgtagttacttacgtgactacgtcctacaataccgtacctaacccggagggtacctacgtcgttcggttatacgtttaacggttcgggaacggggacgggttaccgttcgggtccgtacggtcccggttccgtaccggttaccgaaccgaacccgtaaccggg

SEQ ID NO: 375998 - DNA, 507 bp, Homo sapiens
  misc_feature: GZ8MTXP01CTJ4T.10.72.G06.1.454.CMB.2.raw
  modified_base (466)..(466): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgcttctctcgcctcaagtctggtcaacacggccttacctgaccatctccgggctcacgtctgaggacgaggctcagtttctactgcagctcatactacacccgagggcatctcgttgattagtcggngacgggcttgggctgccgtcgtacgttcgcgcccgtaacgg

SEQ ID NO: 375999 - DNA, 618 bp, Homo sapiens
  misc_feature: GZ8MTXP01B2EP6.10.72.G06.1.454.CMB.2.raw
  modified_base (303)..(303): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggccaccagcagtgacataggtgcttataactatgtctcctgtaccaacaacacccaggccacggccccagactcatctatttcngatgtacagtgtactcggtccctttgggtactttactatcgtcttctctcgcctctaagtctcggactaacgacggtccttccctgaccctactccgtcccgggccttacccgacgtccgtaggacggacgaggtctactacgtttacttacgtgactacgtctacacttactacccgacccgacggggtccaccgttcgttcgttagtacgttacggtttccgggcgggttaccggggttaccgttcgggtaaccgttcgggtaaccccgttccgtaccggttaccgaacccgggttaaccccgtaacccgggg

SEQ ID NO: 376000 - DNA, 612 bp, Homo sapiens
  misc_feature: GZ8MTXP01BMVPX.10.72.G06.1.454.CMB.2.raw
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaaccaacaacacccagccacgccccagctcatcatttctgatgtcagtgatcggtcctttgggtacttctaatcgtcttctctcgcctcaagtctggacaacacggtctccctgacctatccgtccgggctcccgacgtctggacggacgaggtctctaacggtttattcgttacgcgtacgcctactataacgtaccctaacccgacggggtccaacgttccgtcggttacgtaacgttacggttaccggggaccggggttacggggttacccgttcggggtccgtaccgggtaaccccggttcccgtacccggttaccgaacccggttaaccccgtaaacccgggg

SEQ ID NO: 376001 - DNA, 574 bp, Homo sapiens
  misc_feature: GZ8MTXP01B3GTD.10.72.G06.1.454.CMB.2.raw
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttataactatgtctcctggtaccaacaaccacccacggccacggccccagactcatctatttctgatgtcagtgacgtccggtccgtttgggtactttactatcgtcttctctcgcctcaagtctgacacgcgtccttcctgacctactccgtccgggcctaccgacgcgtacggacggacgaggtctacgtacttattactgacagtctacatactaccgaccgagggccacgtctcgttagtattacggttcgggcgggttaacgggttccgttcgggtcctcggtaacccgtcccgtacgttaccgaaccggaacccgtaaccgg

SEQ ID NO: 376002 - DNA, 529 bp, Homo sapiens
  misc_feature: GZ8MTXP01B64MG.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccagccacggcccccagactcatcatttctgatgtcagtgatcggtcctttgggtactttctaatcgtcttctctcgcctacaagtctggacaacacgccttccctgaccactctcccgggctcccgacgctggacggacgaggctctaagttattactgcagctcatactaccacccgagggcactctcgttgtattacgtcggcggacgggccttggctcgaaccgtcctacgttccaacgcccgtaaccgg

SEQ ID NO: 376003 - DNA, 530 bp, Homo sapiens
  misc_feature: GZ8MTXP01AI8ZL.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgtcttctctgcctcaagtctggcaacacggccttccctgaccatcctccgggctcccagctgaggacgaggctcatttatactgcagctcatatacacccgagggcaactctcgttgtacttacgttcgggcgggagggccttgggccgtcgtaacccgttccgtacggttcctaacggcccgtaaccggg

SEQ ID NO: 376004 - DNA, 622 bp, Homo sapiens
  misc_feature: GZ8MTXP01C45W8.10.72.G06.1.454.CMB.2.raw
  modified_base (242)..(242): a, c, t, g, unknown or other
  modified_base (305)..(305): a, c, t, g, unknown or other
  modified_base (484)..(484): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatcctcctgcactggcaccagcagtgacagtaggtncttataactatgtctctagtaccaacaaccaccacggccacggccccagactcatctatttcngatgtcagtgacgttccggtcccgtttagggtacctttactattcgtcttctctcgtcctacctaagtctacggaccaaccgtaccggtcccttaccctacgtaccctacgttcccgtacccgggtccctaccgaccggtcgtacggacgggacgacggtacttactatttacttacgngtacacgtcctcaagtacctaccgaccggacgggcctacgtcgttcggttagtacgttacggttccgggacgggttacgggccttcgggtcctacggtaacccgttaccgaccgttaccgtaaccgcccgtaaccggg

SEQ ID NO: 376005 - DNA, 571 bp, Homo sapiens
  misc_feature: GZ8MTXP01B27E5.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactggcaccagcagtgacataggtgcttataactatgtctcctggtaccaacaacacccaggcccaggcccccagactcatcatttctgatgtcagtgactcggtccctttgggactttctaatcgtcttcgtctcgccctccaagtcctggcaacacggtccttccctgacccatccgtccgggctcccgacgtcgtggaggacgaggctcgagttattactgcagtctacataactaccgacccgacggggcctacgtctccgttaggtacttacgttccggggtcgggaacggggttccgttcgggtcgtcggtaacccgttcccgtaccgttccgaaccgccccgtaaccggg

SEQ ID NO: 376006 - DNA, 723 bp, Homo sapiens
  misc_feature: GZ8MTXP01D3TPP.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcactgcacagcagtgacagtaggtgcttataactatgtctctggtaccaacaacacccaggccacggcccccagactcatctatttctgatgtcagtgacgtcggtccctttggtactttctaatcgtcttctctcgtcctacctaacgtcgttacgggaccaacgtaccgggtccctttcccctacggtaacccctacgttcccgtccccggggtccttaccccgaccggtaccgtacgggaacggggaaccgtaacggggtaccttaccggtaatttttaacgtttaaaccgttcgggtaacctacggtccttaaccgtaactttaaaccgttaaccccggaaaccccgggtaaacgggggtcccctaaccggttaaccgttcggttaacggttaacgtttaaacggtttccgggggaccgggttaacggggacccgtttcggggaacccgttaccggtaacccggttcccgtaaccgttccgaaccggttaaccccgtaacccgggg

SEQ ID NO: 376007 - DNA, 496 bp, Homo sapiens
  misc_feature: GZ8MTXP01BBEEM.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgcttctctgcctcaagtctgctaacacgcttccctgaccatctccgggctccacgctgagacgaggctcattattactgcagctcatactacacccagggcactctcgttgattagtcggcggacgggcttggctgccgtcacgttcaacgccgaacgg

SEQ ID NO: 376008 - DNA, 556 bp, Homo sapiens
  misc_feature: GZ8MTXP01AHP57.10.72.G06.1.454.CMB.2.raw
  modified_base (241)..(241): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtnacttataactatgtctcctggtaccaacaacaccacggccacggccccagactcatctatttctgatgtcagtgactcggtcctttgggtactttctaatcgtcttctctcgcctacaagtctgcaacacggtcttccctgaccctatccgtccgggacctccgacgctaggacggacgacggcttacagttacttactgacagcttacattactaccgtacccgaggggtcctaactcgtcgttgtacttacgttcgggacgggacgggttcttcggtctcggtaacccgtccgtacgacaacgcccgtaacgg

SEQ ID NO: 376009 - DNA, 529 bp, Homo sapiens
  misc_feature: GZ8MTXP01ESOHK.10.72.G06.1.454.CMB.2.raw
  modified_base (380)..(380): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggtcccgtttggtactttctaatcgtcttctctcgcctctaagtctggacaacacggtcttcccngaccatcgtccgggctccgacgcctggacggcgaaggctctagttacttactgcagctcatactacacccgaagggccacgtctcgttgacttagttcggcggaggccttgggtctcgtaacctcgacgttccaacgttcccgaaccgg

SEQ ID NO: 376010 - DNA, 646 bp, Homo sapiens
  misc_feature: GZ8MTXP01AXWM7.10.72.G06.1.454.CMB.2.raw
  modified_base (245)..(245): a, c, t, g, unknown or other
  modified_base (329)..(329): a, c, t, g, unknown or other
tcagcatagtagtgcacgaccggtgctcgatttagctacgactgcaagggaaagggggtctcaggaggcagcgctctcgggacgtctccactatggcctgggctctgctattcctcaccctcctcactcagggcacagggtcctgggcccagtctgccctgactcagcctgactccgtgtcgtgggtctccgtggacagtcgatcactatctcctgcacgtggccacagcagtgactagtaggtnacttaataactatcgtctaccgtacggtaaccaaacaaccacccgacggacccgaaccggcccccaagacctcactctatttcngtatgtacagtcgtacgtcgtccgtttaggtacctttctatcgtcttctctcgtcctacgtaaacgtccacgaccaaccgtacgtcccttccctacgaccctacgtcccgtacccgggtcttacccgacgtcgtacggacggacgtaacgtctacgttaacgttacttacgtcgaccgaatcctactagttaacctaccgacccggtacgggtaccttacgtcgttacgttacggttacttaacggggttccgggacggggttacggttaccgttcggtctaccgtccgtaccgtacgccgtaaccgccgtaaccgg

SEQ ID NO: 376011 - DNA, 553 bp, Homo sapiens
  misc_feature: GZ8MTXP01DR9XL.10.72.G06.1.454.CMB.2.raw
  modified_base (253)..(253): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactcgtgtctggtctcctggacagtcgatcactatctcctgcactggcaccagcagtgacataggtgcttataactatgtcncctggtaccaacaacacccaggccaggcccccagactcatcatttctcgatgtcagtgactcggcctttgggtactttctaatcgtcttctctgccctcaagtctcggacacacggtccttccctgaccatcgtcggctccacgctgaggacaggctactattactactgaccagtctcataactaccaacccgagggccactaactcggttactagttacgttcgggacgggacgggttcccttggggtcctcgggaacccgttcccgtaccgttacaacccgggaaccgaacccgggg

SEQ ID NO: 376012 - DNA, 625 bp, Homo sapiens
  misc_feature: GZ8MTXP01ELI1B.10.72.G06.1.454.CMB.2.raw
  modified_base (239)..(239): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcaggcacagggtcctgggcccagtctgccctgactcagcctgactccgtgtctgggtctcctggacagtcgatcactatctctgcactgcacagcagtgacataggtncttataactatgtctcctgtaaccaacaacaccacggccacggccccaagacctcatctatttctgtatgtcagtgtacgtcggtcctttggactttcgtaaatcgtcttctctcgtcctaccaagtctacggacaacgacggtccctttccctacgacctacgtccgtccgggtcctaccgacgtctaggacggacgacggtactcctaagtttaactaacgtgacctagtacctacgtaataaccgtaaccaacccggtaacgggtaccacgttaacgttcgttacggtattacggttaccgggacggggaacgggttccgttcgggaaccgtacggtaacccggttcccgtaaccggttacgaacccgttcccgtaacccggg

SEQ ID NO: 376013 - DNA, 560 bp, Homo sapiens
  misc_feature: GZ8MTXP01AD73E.10.72.G06.1.454.CMB.2.raw
  modified_base (243)..(243): a, c, t, g, unknown or other
  modified_base (311)..(311): a, c, t, g, unknown or other
  modified_base (369)..(369): a, c, t, g, unknown or other
  modified_base (412)..(412): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatcctcctgcactggcaccagcagtgacataggtncttataactatgtctcctaggtaccaacaaccacccacggccacggcccccagacctcatctatttcngatgtcagtgactcggtccttggtacttcatcgcttcgtctcgcctcagtctgcaacncgtctccctgaccatccgtccggctccgacgctggacggacgnggtctactagtttactacgtgcgatctacgattacaaccacccgagggcctaccgtctcgttagtacgttacggttcgggacggttacgggccttcgggtcccgtacgtcccgttcccgtaaccgttccgtaaccgcccgtaaccggg

SEQ ID NO: 376014 - DNA, 534 bp, Homo sapiens
  misc_feature: GZ8MTXP01DGMYX.10.72.G06.1.454.CMB.2.raw
  modified_base (259)..(259): a, c, t, g, unknown or other
  modified_base (307)..(307): a, c, t, g, unknown or other
  modified_base (438)..(438): a, c, t, g, unknown or other
  modified_base (497)..(497): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtcncctggtaccaacaacacccaggccaggcccccagactcatctatttcngatgtcagtgatcggtcctttggactttctaatcgtcttctctgtcctcaagtctggacacgacggtcttccctgacctatccgtccgggctccacgtctggaggacgaggctactagttacttagtgcancctcatactaccgaccacgggcactctgttgtattagtcgggcggacgggttcttcggntacgaaccgtcgtagttccgtaacgcccgtaaccggg

SEQ ID NO: 376015 - DNA, 737 bp, Homo sapiens
  misc_feature: GZ8MTXP01CIU16.10.72.G06.1.454.CMB.2.raw
  modified_base (229)..(229): a, c, t, g, unknown or other
  modified_base (318)..(318): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccngcagtgacataggtgcttataactatgtctcctggtacccaaacaacacccaggcccacggcccccagactcatctatttctgatgtcngtgatcggtcctttgggactttctatcgtcttctctcgtccctacgtaagtccgttcgggacctaacgtaccgggtccctttacccccgtacgtaccccgtaacgttcccggttaccccgggggtcccttaccccggaaaccgggtccgttacgggaaacgggtaccggaacgggtccttaccgttaaaggtttttacttaaccgttcggacctaacgtccttaacgaactttaaaccgtacccgtaaccccgggaagggggtaccctaacccgttccgttaccgggttagtaacggtttaaaccggtttccgggggcgggggttaaaccgggggttccccgttagggggtcccttaccggggtaaaccccgttccgtaaacccgggttccgaacccggttccccggtaaaccccgggg

SEQ ID NO: 376016 - DNA, 576 bp, Homo sapiens
  misc_feature: GZ8MTXP01BANPJ.10.72.G06.1.454.CMB.2.raw
  modified_base (223)..(223): a, c, t, g, unknown or other
  modified_base (239)..(239): a, c, t, g, unknown or other
  modified_base (394)..(394): a, c, t, g, unknown or other
  modified_base (442)..(442): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggcacngcagtgacagtaggtncttataactatgtctctggtaaccaacaacacccaggccacggcccccagacctcatctatttctgatgtctagtgacttcggtccgtttgggtactttctaatcgtcttctctcgcctcaacgtctcggacacgacgtctccctgaccactccnccgggctccgacgctggagacgagctacagtttatacgtcacacgtcnctaacgtaactaccgaacccgtaggggacctaacgtcttcgttagtacgttagttccggggacgggcgggttaccgttcgggtccgttacggtaaccgttccgtaccggttacgaaccggttcccgtaaccggg

SEQ ID NO: 376017 - DNA, 660 bp, Homo sapiens
  misc_feature: GZ8MTXP01DI8JT.10.72.G06.1.454.CMB.2.raw
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcacagcagtgacagtaggtgtacttaataactatcgtcctccgtacggtaacccaaaccaaaccacccgacggacccgacggacccccaagacctcactctatttctgtatgtctagtgtacgtccgtccgtttggtactttactatcgtcttctctcgcctctaagtcgtacgaccaacgtaccggtcccttcccgcgtaccctacgtccgtcccgggtcctacccgacgcgtacggacggacgtacggtcttactaacgtttactttaacgtcgtactacgtctactaactaactaacccgtaacccggacggggtaccaccgttcgttacggttaggtaacgttacggttaccggggacgggttacggggttaccttcgggtccgtaccggtaacccgttaccgtaccgttaccgtaaccgccgtaacccggg

SEQ ID NO: 376018 - DNA, 530 bp, Homo sapiens
  misc_feature: GZ8MTXP01AJQZK.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggcaccagcagtgacataggtgcttataactatgtctcctggtaccaacaacacccaggccacggcccccagctcatcatttctgatgtcagtgatcggccctttgggtactttctatcgtcttctctcgcctccaagtctggacacacggtccttccctgaccatccgtccgggctcccgacgcgtgacggacgaggctacatttagtactgcagtcacatactaccaccgagggccacgtctcgttgattcgttcgggcggttagggccgttggcctcgccgtccgtacgttcaacgcccgtaaccgg

SEQ ID NO: 376019 - DNA, 575 bp, Homo sapiens
  misc_feature: GZ8MTXP01BEN7M.10.72.G06.1.454.CMB.2.raw
  modified_base (240)..(240): a, c, t, g, unknown or other
  modified_base (309)..(309): a, c, t, g, unknown or other
  modified_base (464)..(464): a, c, t, g, unknown or other
  modified_base (467)..(467): a, c, t, g, unknown or other
  modified_base (514)..(514): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctggtctccgtggacagtcatcactatctctgcactggcacagcagtgacagtaggtncttataactatcgtctcctaggtaaccaacaaccacccacggcccacggccccagactcatctatttcngtatgtcagtgactccggtcctttggtactttactatcgtcttctctcgtcctacaagtctacggacaaccgtacggtcccttccctacgtaaccctacgtcccgtcccgggccttacccgacgcgtagacggacgacggtctactattactctnacngctcatacaccaccgtagggccacgtctcgagtcgttacgttcgggnggacggttacttcggcctacgtaacccgtccttcggacccaacggttccccgtaacccggg

SEQ ID NO: 376020 - DNA, 569 bp, Homo sapiens
  misc_feature: GZ8MTXP01C0IDD.10.72.G06.1.454.CMB.2.raw
  modified_base (244)..(244): a, c, t, g, unknown or other
  modified_base (307)..(307): a, c, t, g, unknown or other
  modified_base (351)..(351): a, c, t, g, unknown or other
  modified_base (455)..(455): a, c, t, g, unknown or other
  modified_base (485)..(485): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtncttataactatgtctctagtaccaacaacacccacggccaggcccccagacctcatcatttcngatgtcagtgatcggtcctttggactttctatcgtcttctctcncctcaagtctcggcaactccggacttccctagaccctagtccgtccgggtcctaccgacgtcgtaggacggacgacggtctactatttacgtactgcagcctanatactacacccggagggccaacgtctacgngtacttcgttacggggcgggttaacgggccgttgggccctcggtaacccgtccgtacggttaccaaccgggccccgtaaccggg

SEQ ID NO: 376021 - DNA, 635 bp, Homo sapiens
  misc_feature: GZ8MTXP01DJCK0.10.72.G06.1.454.CMB.2.raw
  modified_base (228)..(228): a, c, t, g, unknown or other
  modified_base (234)..(234): a, c, t, g, unknown or other
  modified_base (258)..(258): a, c, t, g, unknown or other
  modified_base (301)..(301): a, c, t, g, unknown or other
  modified_base (388)..(388): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcacngcagtnacataggtgcttataactatgtcnctgtaccaacaacacccagccacgccccagactcatcatttcngatgtcagtgactcggtcccgtttaggtactttctaatccgtcttctctcgcctacaagtctcggaccaacgtaccggtccttcccngacctacgtcctcccgggctcccgacgtcgtacggaacggacgtaggtacctacgttaacgttacttttaacgtcggacctacgtcctacgtaacttaaaccgtacccgtaacccggaacggggtccctaacgtccgttccgttagtacggttaacggttcggggaccggggttaaccgggttacgttcgggtccgtacgtaacccggttcccgtacggttaccgaaccggttcccggtaacccggg

SEQ ID NO: 376022 - DNA, 525 bp, Homo sapiens
  misc_feature: GZ8MTXP01C7FNL.10.72.G06.1.454.CMB.2.raw
  modified_base (254)..(254): a, c, t, g, unknown or other
  modified_base (301)..(301): a, c, t, g, unknown or other
  modified_base (370)..(370): a, c, t, g, unknown or other
  modified_base (401)..(401): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcacagcagtgacataggtgcttataactatgtcncctggtaccaacaacacccaggccaggcccccagactcatcatttcngatgtcagtgatcggcctttggactttctaatcgcttctctgcctcaagtctggcaacacgcttccctnaccatctccgggctaccacgctggaggacgnggctctatttacttacgtgcagctcatactacacccgtaggggctcgtctcgttgtattgttcgggcgggaacgggcttgggcttcggaacccgttccgtacgttctaaccgcccgtaaccggg

SEQ ID NO: 376023 - DNA, 592 bp, Homo sapiens
  misc_feature: GZ8MTXP01D5WRE.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactggcaccagcagtgacataggtgcttataactatgtctctgtaccaacaacacccagccacgccccagactcatcatttctgatgtcagtgtactcggtcccgtttggtactttctaatcgcttcctctcgtccctccaaagttctgggacaacgtaccggtccttcccctagaccctactccgtaccgggccttacccgacgtcgtaggacggacgaggtcctactaatttactaacgttgaccagtctactattaacacctaacccggagggtccaacgtctacgttcgtaattaggttaccgggacgggttagggcccgttaggtcctcggtaacccgttcctaccggttacgtaaccgcccgtaaccgg

SEQ ID NO: 376024 - DNA, 642 bp, Homo sapiens
  misc_feature: GZ8MTXP01A9653.10.72.G06.1.454.CMB.2.raw
  modified_base (205)..(205): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcatcactntctctgcactgcacagcagtgacataggtgacttataactatgtctcctaggtaaccaacaacacccgacggcccacggccccagacctcatctatttctgtactgtctagtgtacgtccgtccgtttggtactttctaatcgtcttctctcgtccctactaacgttcgtacggacctaaccgtaccggtccttcccgtactaccgtacgtccgtcccgggccttacccgacgtccgtacggacggaccgtacggtaccttactaacgtttaacttacgtcggtacgtactcctactacttaaacctaccgtaaccccggagggtcccaacgtccgttacgttagtacgttaggttaccgggacgggacgggttacccgttggtaaccgtacggtaacccgttcccgtaccgttaccgaaccgttcccggaacccgg

SEQ ID NO: 376025 - DNA, 645 bp, Homo sapiens
  misc_feature: GZ8MTXP01APYO2.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacacacccaggccacggccccagactcatctatttctgatgtcagtgactcggtcctttgggactttctaatcgtcttctctcgtcctcctaaagtctggaccaacacgggtcccttacccgtcgacctacgtccgtccgggcttacccgacgtctacgggacgggacgacgggtacttactaacgtttaacttaccgttcgacgtacggtccttacctaattaaccttaaaccgaaccccgtaaacgggggtaccctaccgttaaccgtaccgggttagtaaacgtttacggttaccgggggacgggttaaacggggttcccgttaggggccttacggaacccgttaccgtaccgttacgtaaccggcccgtaacccggg

SEQ ID NO: 376026 - DNA, 618 bp, Homo sapiens
  misc_feature: GZ8MTXP01A6ECK.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggccaccagcagtgacataggtgtcttaataactatgtctcctaggtaccaacaaccacccagccacggcccccagactcatctatttctgtatgtacagtgacttccggtccctttgggtactttctaatcgtcttctctgtccctacgaagtctcggaccaaccgacggtccctttccccgtagtaccctacgtcccgtcccggggcttacccgacgtcgtacggaacgggacgacggtctactagtttacttactcgacctagtcctactaactactaccacccggtagggtcctaacgtcgttacgttagtacgttcggttacgggcggggaacggttccgttcgggtcctacggtcccgttaccgtacgttacgtaaccgttcccgaaccggg

SEQ ID NO: 376027 - DNA, 611 bp, Homo sapiens
  misc_feature: GZ8MTXP01CLNNG.10.72.G06.1.454.CMB.2.raw
  modified_base (246)..(246): a, c, t, g, unknown or other
  modified_base (400)..(400): a, c, t, g, unknown or other
  modified_base (405)..(405): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggccacagcagtgactagtaggtncttaataactatgtctcctaggtaaccaaacaaccacccacggccaccggcccccagacctcactctatttctgatcgtacagtgtacgtcggtccgtttaggtactttacgtatcgtcttctctcgcctctaagtctgccaacgtcgtctccngaccntccgtccggctaccgacgtcgtaggacggacgacgtctactaattacttaacgtcgacgtatcctactaactaacgtaacccgaccggtacgggtacctaaccgttccgtacggttacgtaacgttacgggttaccggggcgggaaccgggttccgttacggtcgtaccgtaacccgttcgaccgttcgaaccgcccggtaaccgg

SEQ ID NO: 376028 - DNA, 646 bp, Homo sapiens
  misc_feature: GZ8MTXP01BJ52N.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagttaggtgcttaataactatgtctcctaggtaccaacaacaccacggccacggccccagactcatctattctagatgtcagtcgagtcggtcccgtttgggtactttctaatcgtcttctctcgcctcgtaagtctcggacctaaccgtacgggtccttaccctgaccctacgtccgtcccgggcttacccgacgtctacgggacgggacgtacggacttacgtaacgtttacttaacgtcgacgtaagcccttacgtaactaacctacccgaacccgtacggggcctaaccgttcgtacgttacggtagttacggttaccggggacgggttaacggggttcccgttcgggtaacctaccgggtaaccccggttccgtaccgggttccgtaaccggaaccccggtaaccggg

SEQ ID NO: 376029 - DNA, 608 bp, Homo sapiens
  misc_feature: GZ8MTXP01D5M37.10.72.G06.1.454.CMB.2.raw
  modified_base (300)..(300): a, c, t, g, unknown or other
  modified_base (442)..(442): a, c, t, g, unknown or other
  modified_base (455)..(455): a, c, t, g, unknown or other
  modified_base (465)..(465): a, c, t, g, unknown or other
  modified_base (472)..(472): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcacagcagtgacataggtgacttataactatgtctctagtaccaacaacaccagccacggccccagactcatctatttcngtatgtcagtgtacgtcggtccgtttaggtactttacctaagtccgtcttctcctacgtcctacaagtcgtcggaccaacgacggtccttcccgtacgaacctagtccgtccggctaccgacgctggacgtacgagccttanagtttactacgtnacaactctanattaacnccgtaaaccggcgggactaacttctcggttacgtagttaaacggttccgggcggggttaaaccgggttccgttacgggtaaccgttccggaaccgttccccgttaccgacgaacccgttaaccccggtaacccggg

SEQ ID NO: 376030 - DNA, 692 bp, Homo sapiens
  misc_feature: GZ8MTXP01AQ6A4.10.72.G06.1.454.CMB.2.raw
  modified_base (209)..(209): a, c, t, g, unknown or other
  modified_base (224)..(224): a, c, t, g, unknown or other
  modified_base (240)..(240): a, c, t, g, unknown or other
tcagcatagtagtgcacgaccggtgctcgatttagctacgactgcaaggggaaagggggggtctcaggaggcagcgctctcgggacgtctccaccatggcctgggctctgctattcctcaccctcctcactcagggcacagggtcctgggcccagtctgccctgactcagcctgactccgtgtctggtctccgtggacagtcatcactnctctgcagtgccacngcagtgacattaggtnacttaataactatacgtctcgtaggtaacccaaacaaccacccacggccaccggcccccaagactcagtgttacgttttgattgtactagtaacgtccgtccgtacgtagggtttctaacgtcgtcttctcgtcggaccttacgaacgtcgtacgacctaaccgacccggtcccttacccgtacgaccctacgttccgtcggtcgggaccttccgacggtccgtaggacggtacgaacgtcgtagtattacgtacgtcggactacgccttacgaattaaactaaccgtaaaccctaggtacccacgttaaccgtaacctttccgttagggttaccggttaccgggtaaccggggtaacgggaaccgttaaacccgggttcgtaaccccgttaccggtttaaccccggacgggtaccgttaaccccgggaaccccgtttaacggtccccccgg

SEQ ID NO: 376031 - DNA, 650 bp, Homo sapiens
  misc_feature: GZ8MTXP01ASQIR.10.72.G06.1.454.CMB.2.raw
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctccgtggacagtcgatcactatctctgcactggcaccagcagtgacagtaggtgacttataactatcgtctccgtacggtaaccaacaaccacccgacggcccacggccccagactcatctattctgatgtcagtgacgtcggtccgtttggtactttctatcgtcttctctcgtccctactaagtccgtcgacctaaccgtaccggtcccttacccgtcgtaaccctacgttcccggtcccgggtcctacccggtaccgtccgtacggggaacgggaccgtaacgggtaccttactaacgttttacttaaccgttgacctacgtacctactaacttaactacccgtaacccggacggggtcctaacgttcgtcggttagtacgttacggtacgggcgggttacgggttccgttacggtcgtcgtaacccgtcgtaccgttcgaaccgcccgtaaccgg

SEQ ID NO: 376032 - DNA, 678 bp, Homo sapiens
  misc_feature: GZ8MTXP01AW3OX.10.72.G06.1.454.CMB.2.raw
  modified_base (256)..(256): a, c, t, g, unknown or other
  modified_base (311)..(311): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggcacagcagtgacataggtgcttataactatgtcncctggtaccaacaacacccaggccacggcccccagactcatctattctgatgtcngtgagtcgtcctttggtactttctaatcgtctctctcgcctccaagtctcggcaacgacggtccttcccctgaccctatcccgtccggggcttacccgaccgtcgttacgggaacggaccggacgggtaccttacccgtaagttttaacttaaaccgtttcggccctaaacggtccccttacgtaaactttaaccgtaaacccctacccccgggaacgggggtacccctaaaccggttaaccgttcccgggttggtaaacgtttaacggtttcccggggaacggggttaacggggttcccgttcgggtaacccgtacggtcccgttacccgttacggttactaacccggttaacccgtaacccgggg

SEQ ID NO: 376033 - DNA, 650 bp, Homo sapiens
  misc_feature: GZ8MTXP01D64TA.10.72.G06.1.454.CMB.2.raw
  modified_base (313)..(313): a, c, t, g, unknown or other
  modified_base (490)..(490): a, c, t, g, unknown or other
  modified_base (495)..(495): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactcgtgtcgtgggtctcctggacagtcgatcactatcctctgcactggccaccgagcaagtgacagtaggtgattaataactatgtctcctaggtaaccaacaaaccaccacggccacggcccccagactcatctatttcngtatgtcagtgacttccggtccgtttaggtactttactaatcgtcttctcctcgtccctacgtaagtcgtcggtacaacgaccggtcctttacccgtgaccctacgtcccgtaccgggccttacccgacggctagggaacggacgtacggtccttacgtatttactacgtgacgtanacctntaacgtactaccgaccgtagggcctacgtcgtacggttcgtaaacgtttacggtaccggggacgggaacgggttcccgttcgggtaaccgttacccggtaacccgtttcccgggtaaacccgttccggaacccggttaaccccggtaaacccggg

SEQ ID NO: 376034 - DNA, 616 bp, Homo sapiens
  misc_feature: GZ8MTXP01DLMW2.10.72.G06.1.454.CMB.2.raw
  modified_base (195)..(195): a, c, t, g, unknown or other
  modified_base (228)..(228): a, c, t, g, unknown or other
  modified_base (237)..(237): a, c, t, g, unknown or other
  modified_base (353)..(353): a, c, t, g, unknown or other
tcagcatagtagtgcacgaccggtgctcgatttagctacgactgcaagggaaagggggtctcaggaggcagcgctctcgggactctccaccatggcctgggctctgctattcctcaccctcctcactcagggcacagggtcctgggcccagtctgccctgactcagcctgactccgtgtcgtggtctcctggacngtcgatcactatctcctgcactgcacagcagtnacataggtncttataactatgtctctaggtaccaacaacacccgacgccacggccccagactcatctatttcgtgtatgtacagtgtcgtccgtccgtttggtactttactatcgtcttctctcnccctactaacgtctcgacaacgtcgtcccttccgtgacctcgtccgtccggctacccgacgtcgtggacggacgtgtaccttagtacgtttacttacgtacgtacgacgtacctacgtaaattaaaccgaccgaacccgggtacgggtcctaaccgtttccgacggtttagtaaacgttacggtaccgggggacgggttaccggttacggttcggtaaccgtacgtaaccgtcccgtacgaccgtaaccgaacccgtaaccgg

SEQ ID NO: 376035 - DNA, 606 bp, Homo sapiens
  misc_feature: GZ8MTXP01B8ZB1.10.72.G06.1.454.CMB.2.raw
  modified_base (244)..(244): a, c, t, g, unknown or other
  modified_base (254)..(254): a, c, t, g, unknown or other
  modified_base (307)..(307): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtncttataactntgtctcctagtaaccaacaacacccaggcccacgccccagactcatcatttcngatgtcagtgactcggtcctttggtactttctaatcgtcttctctcgtcctaccaagttcgtcggcctaacgacggtcccttccctcgaccctagtccgtcccgggcctacccgacgctaggacggaccgtaggtcctacgtaatttacttaactcgactacgcctactaagttaacctaccgaaccccggtacgggtcctacgtcgttacgttggtaacttacgggttcgggccggggttacgggaccttcgggctccggtaaccgtacccgttacgccgtaaccgcccgtaaccggg

SEQ ID NO: 376036 - DNA, 656 bp, Homo sapiens
  misc_feature: GZ8MTXP01BDGRD.10.72.G06.1.454.CMB.2.raw
  modified_base (382)..(382): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggcccacgccccagactcatcatttctgatgtcagtgactcggtcctttggtacctttctaatcgtcttctctcgcctcaagtctggccaacgcgtccttcccncgacctatccgtccgggctacccgacgcgtaggacggaccgaggtaccttacgtacgtttaacttaccgtcgactacgtacctacctaaattaaacctaacccgaacccccgggtaggggtccctaaaccgtttcccgtacggtttacggtaaacgtttaccggtttacccgggggaccggggttaaccgggggttacccttcgggggtcccttacgggtaaccccgtttacccgtaaccgggttaccaaccgggttaaccccgtaacccgggg

SEQ ID NO: 376037 - DNA, 649 bp, Homo sapiens
  misc_feature: GZ8MTXP01B0NJ4.10.72.G06.1.454.CMB.2.raw
  modified_base (231)..(231): a, c, t, g, unknown or other
  modified_base (237)..(237): a, c, t, g, unknown or other
  modified_base (248)..(248): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacgagggtcctgggcccagtctgccctgactcagcctgactccgtgtcgtgggtctccgtggacagtcgatcactatctcctgcactggcacngcagtnactagtaggtnacttatactatgtctctacggtaaccaacaacacccgacggcccacggccccagactcactctatttctgtatcgtactaggtcgtagttccggttccgtttggggtactttacttaagttcgtcttctctccgtcctcgtaacgttccgtacggacctaacgtaccggtcccttaccctacggaccctacgttccgtccgggtcctaccggtacgtccgtacgggacggacgtacggtctacgtatttacttacgtcgacgacgtctactaacgtaccaccgtaccgggacgggtcctacgttcgtacgttggaaacgttcggtaccggggtcgggacgggttccgttcgggaacgttccggtaacccgtctacggttaccgtaaccgcccggtaacccg

SEQ ID NO: 376038 - DNA, 666 bp, Homo sapiens
  misc_feature: GZ8MTXP01ENJOY.10.72.G06.1.454.CMB.2.raw
  modified_base (308)..(308): a, c, t, g, unknown or other
  modified_base (493)..(493): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccacgccacggcccccagactcatcatttctgatntcaagtgatcggccctttgggtacttcgttaaatcgtcttccttctcgtcccgtcctaaacgtctacgggactaaaccaacgggtcccttacccttagaccctaacgttccgtccccggggcttaccccgaacgttccgtcgacgggacccgagggaccttctaacgtttaactttaaccggttnaccgaacgcgttccctaataaccgttaaccaaccccggtaggggtaccacccggttaactcccgttggaactttaaggttcccgggacggggttaccggggttaaccgttcgggtcccgtaacggtccccggttaccctaaccggttaccgtaaccggcccgtaaacccgggg

SEQ ID NO: 376039 - DNA, 664 bp, Homo sapiens
  misc_feature: GZ8MTXP01EQY81.10.72.G06.1.454.CMB.2.raw
  modified_base (199)..(199): a, c, t, g, unknown or other
  modified_base (228)..(228): a, c, t, g, unknown or other
  modified_base (245)..(245): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacgagggtcctgggcccagtctgccctgactcagcctgactccgtgtcgtgggtcctcgtggacngtcgatcactatctcctgcagtgaccacngcagtgactagtaggtnacttaataactatcgtcctacgtacggtaaccaaacaacccaccgacggcccaccggaccccaagtacctcacttactactttcagtattcgtactaggtcgtacgtccggttccgtttaggtacctttactactcgtacttcctacgtctccgttacaacgttcgacgaacctaaccgtcgtcccttaccgtgaaccctctccggccggtctacccgagtacgaggacggtaccgagtcctacttagttaacgttcgcgttacacgtcctaacgtaagttaccgaaccgaccgtacgggtccttaacgtccgtcgttaggtaaacccgttgggtacccgggggaacggaccggttccggttcggtcccgttacgtaacccgttcgtaccggaccgaacccggttaaccggtaacccgg

SEQ ID NO: 376040 - DNA, 696 bp, Homo sapiens
  misc_feature: GZ8MTXP01DPARW.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacgagggtcctgggcccagtctgccctgactcagcctgactccgtgtctgggtctcctggacagtcgatcactatctcctgcatggcaccagcagtgacataggtgcttaataactatcgtctcctaggtaaccaaacaaccacccacggccacggcccccagactcatctatttctagatgtacagtgactcggtccgtttggtactttactaagtcgtcttcctctacgtcctaccgtaaagtcgttacggactaaccgtacggtccctttcccgtagaccctacgtcccgtccgggtaccctacccgtaacgtcgtacggaacggacggtacggtccttaactaacgtttaacttaacgtcgtaccgtacgaccttacgtaacttaaccgtaacccgaaccggtacggggtaccctaacggttccgttaccggttagtaaccgttaacggttacccgggggaacggggttaaccgggttacccggtttcggaaccggtaccggttaacccgttacccgttaaccgttacccggaaccgaaccccgttaacccgggg

SEQ ID NO: 376041 - DNA, 661 bp, Homo sapiens
  misc_feature: GZ8MTXP01DXIVH.10.72.G06.1.454.CMB.2.raw
  modified_base (300)..(300): a, c, t, g, unknown or other
  modified_base (305)..(305): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctggtctctggacagtcatcactatctcctgcactggcaccagcagtgacagtaggtgcttatactatgtctctagtaccaacaacaccagccacggccccagctcatctatttcngtatntacagtgtacgtccggtacctttgggtacctttactaacttcgtcttctctcgtcctacgtaaacgtcgtacggaccaacgtccgtccttccctagacctacgtccgtccgggcctacccgacgtacgtgggaacggtaccgaggtacttacgtaacttttaacgttcgtacggtaccctaagtcccttaactaactaaaccgttacccgtaacccgggacgggtacccttaacgttcggttacggttaggtacgtttaaacgggttcgggggaccgggttaacgggttccgttcggtccgttaccggtaacccggttctaccgggttaccaaccgggttaacccggtaacccggg

SEQ ID NO: 376042 - DNA, 491 bp, Homo sapiens
  misc_feature: GZ8MTXP02JGO7F.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttatgatgtcagtgatcggccctttgggatttctaatcgcttctctgcctccaagtctgcaacacggcttccctgaccatctcggctccacgctgagacgaggctcattattactgcagctcatatacacccaggggcactctcgtgatattcggcggacggacctggcgtgaccgtctacgtcacgccaacg

SEQ ID NO: 376043 - DNA, 494 bp, Homo sapiens
  misc_feature: GZ8MTXP02HKTN6.10.72.G06.1.454.CMB.2.raw
  modified_base (302)..(302): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactggcaccagcagtgacataggtgcttataactatgtctcctggtaccaacaacacccaggccaggcccccagactcatcatttcngatgtcagtgatcggcctttggactttctaatcgcttctctgcctcaagtctgcaacacggcttctctcgaccatctccgggctccacgctgagcgaggctcatttatactgtcagctcatactacaccgagggcactctcgtcgatacgttcggcggtaggacctggctcgaccgtctacgtcacgacccg

SEQ ID NO: 376044 - DNA, 484 bp, Homo sapiens
  misc_feature: GZ8MTXP02JLSR4.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgtggtgttatgacttgtctcctggtaccaacagcagccaggcgaagcccccaaattcatgatttatgatgtcagtgcgcggccccctcggggtccctgatcgcttctctggctccagtctggcacacgcctccctgaccatctctggcctccagcctgaggatgaggctgattatactgttgctcatatgcaggcgtaccgcgttgggtcgttcggcgagggaccaaggctgaccgtctacggtcagcccg

SEQ ID NO: 376045 - DNA, 502 bp, Homo sapiens
  misc_feature: GZ8MTXP02HEYW1.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcctttgggactttctaatcgcttctctgcctcaagtctgcaacacggccttccctgaccatctccgggctccacgctgaggacgaggctcattattactgcagctcatatacacccgaggggcacgtctacgtgatattcggcggacgggacctggcgtcgaccgtctacgtcacgccgaacgg

SEQ ID NO: 376046 - DNA, 492 bp, Homo sapiens
  misc_feature: GZ8MTXP02F77M6.10.72.G06.1.454.CMB.2.raw
  modified_base (423)..(423): a, c, t, g, unknown or other
tcagcatagtagtgcacgaccggtgctcgatttagctacgactgcaagggaaaggggggtctcaggaggcagcgctctcgggacgtctccaccatggcctggactctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcctttgggactttctaatcgcttctctgcctccaagtctgcaacacggcttccctgaccatctccgggctccacgctgaggacgaggctcattatactgcagctnatatacaccagggcactctcgtgatagtcggcggacggctggctcgaccgtcgtacgtcacgccaacgg

SEQ ID NO: 376047 - DNA, 491 bp, Homo sapiens
  misc_feature: GZ8MTXP02J1U0H.10.72.G06.1.454.CMB.2.raw
  modified_base (440)..(440): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctgcaacacggcttccctgaccatctccgggctcacgctgagcgagctcattatactgcagctcatatacacccaggggcactcncgtgatattcggcggacgggacctggctgaccgtcctacgtcacgccacgg

SEQ ID NO: 376048 - DNA, 494 bp, Homo sapiens
  misc_feature: GZ8MTXP02FRJP6.10.72.G06.1.454.CMB.2.raw
tcagcatagtagtgcacgaccggtgctcgatttagctacgactgcaagggaaagggggttctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcccctttggggatttctaatcgcttctctgcctccaagtctgcaacacggcttctctgaccatctccgggctccacgctgaggacgaggctcattattactgcagctcatatacacccaggggcactctcgtgatattcgcggaggacctggctgaccgtcctacgtcacgacccg

SEQ ID NO: 376049 - DNA, 501 bp, Homo sapiens
  misc_feature: GZ8MTXP02I4WQW.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcattctgatgtcagtgatcggcctttggactttctaatcgcttctctgcctcaatctgcaacacgcttcctgaccactctccggctccacgctgagactagctcattattactgcagctcatatacaccgtagggcacgtcgtacgtgacgtacgttcggacggacgggtcctaggcgtacgaccgtcctacgtcacgaccgtacgg

SEQ ID NO: 376050 - DNA, 501 bp, Homo sapiens
  misc_feature: GZ8MTXP02F4XQB.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttggggactttctaatcgcttctctgcctccaagtctggcaacacggcttctctgaccatctccgggctccacgctgagacgaggctcattattactgcagctcatatacaccgagggcactctcgtcgatagttcggcggaggacctggctacgaccgtccgtacgtcacgaccccg

SEQ ID NO: 376051 - DNA, 498 bp, Homo sapiens
  misc_feature: GZ8MTXP02JXUWY.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctgcaacacggctccctgaccatctccgggctccacgctgagacgaggctcattattactgcagctcatactacaccgagggcactctcgtgactagttcggcggacgggacctggcgtcgaccgtctacgtcacgccaacgg

SEQ ID NO: 376052 - DNA, 506 bp, Homo sapiens
  misc_feature: GZ8MTXP02GW7B6.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacaccagccaggccccagactcatcatttctgatgtcagtgatcggcctttgggactttctatcgcttctctgcctcaagtctgcaacacggtcttccctgacccatccgtccggcctccacgctgaggacgagctcattattactgcagctacatactaccaccgagggcactctcgtgacttagttcggacggacggaccgtggccgtcgacccgtctacgtccacgcccgtaacgg

SEQ ID NO: 376053 - DNA, 507 bp, Homo sapiens
  misc_feature: GZ8MTXP02JU2WA.10.72.G06.1.454.CMB.2.raw
tcagcatagtagtgcacgaccggtgctcgatttagctacgactgcaagggaaaggggggtctcaggaggcagcgctctcgggacgtctccaccatggcctggactctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcatttctgatgtcagtgatcggcctttggactttctaatcgcttctctgcctcaagtctgcaacacggcttccctgacccatctcccgggctccgacgctgaggacgaggctcatttatactgcagctcatactacaccagggacacgtctcgtgactacttcggcggaacggcccgtggcgtcgaaccgtcctacggtcaacgcccaacgg

SEQ ID NO: 376054 - DNA, 525 bp, Homo sapiens
  misc_feature: GZ8MTXP02HE6O0.10.72.G06.1.454.CMB.2.raw
  modified_base (460)..(460): a, c, t, g, unknown or other
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggccccagactcatcatttctgatgtcagtgatcggccctttgggactttctaatcgtcttctcttgcctcaagtctgacaacacgcttccctgaccatccgtccgggctccgtacggctacggaggaccgaggcctagattatttactgcagctacatatacaacagcacgcacttntacgtagttcgggcggtacgggacctaaagcgtacgacccgtcgaacggtcacgtacccgaacgg

SEQ ID NO: 376055 - DNA, 500 bp, Homo sapiens
  misc_feature: GZ8MTXP02FY6I6.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacaccccaggccaggcccccagactcatcatttctgatgtcagtgatcggccctttgggactttctaatcgtcttctctgcctccaagtctggcaacacggcttccctgaccatcctccgggctccacgctgaggacgaggctcattatactgcagctcatatacacccagggcactctcgtgatattcggcggaacggcctggctgaccgtcctacgtcacgcccaacgg

SEQ ID NO: 376056 - DNA, 506 bp, Homo sapiens
  misc_feature: GZ8MTXP02HVO0N.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcaggacacagggtcctgggcccagtctgccctgactcagcctgactccgtgtctgggtctcctggacagtcgatcactatctcctgcactggcaccagcagtgacataggtgcttataactatgtctcctggtaccaacaacaccccaggccaggcccccagactcatcatttctgatgtcagtgatcggcctttgggactttctaatcgctttctctgcctccaatctggcaacacggcttccctgaccatctccgggctccaccgctgaggacgaggctcattattactgtcagctcatactacacccagggcactctcgtgactagttcgcggacggacctggcgtgaccgtccgtacgtcacgtcccgaacgg

SEQ ID NO: 376057 - DNA, 516 bp, Homo sapiens
  misc_feature: GZ8MTXP02G02QW.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcctttgggactttctaatcgcttctctgcctcaatctggcaacacggcttccctgaccatctccgggctccacgctcggaggacgaggctcgattattactgcagctcatactaccaccgacggggcaacgtctcgtgactacgttcgggcgggaacggccgtggctcggaccgtcctacgtcacgacccgtaacgg

SEQ ID NO: 376058 - DNA, 501 bp, Homo sapiens
  misc_feature: GZ8MTXP02JT72V.10.72.G06.1.454.CMB.2.raw
  modified_base (342)..(342): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggctctttgggatttctaatcgcttcnctgcctcaagtctggcaacacggctccctgaccatctccggctccacgctgagacgaggctcattattactgcagctcatatacacccagggcacgtctcgtcgatacttcggcggacgggaccgtggcttcggaccgtccgtacggtccacgaccccg

SEQ ID NO: 376059 - DNA, 503 bp, Homo sapiens
  misc_feature: GZ8MTXP02J1ZHA.10.72.G06.1.454.CMB.2.raw
  modified_base (302)..(302): a, c, t, g, unknown or other
  modified_base (342)..(342): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacaccaggccaggccccagactcatcatttcngatgtcagtgatcggccctttggactttctaatcgcttcnctgcctccaagtctgcaacacgcttccctgaccatctccgggctccgacgctgaggacgaggctcattattactgcagctcatactacgacccaggggcactctcgtgactagttcggcggacggacctggcgtcgaccgtccgtacgtcacgcccaacgg

SEQ ID NO: 376060 - DNA, 497 bp, Homo sapiens
  misc_feature: GZ8MTXP02FKOAV.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcccctttgggatttctaatcgcttctctgcctccaagtctggcaacacggcttccctgaccatctccgggctccacgctgaggacgaggctcattattactgtcagctcatatacacccaggggcactctcgtgactattcggcgagggacctggctgaccgtctacgtcacgccaacgg

SEQ ID NO: 376061 - DNA, 545 bp, Homo sapiens
  misc_feature: GZ8MTXP02IW269.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacaccagccaggccccagactcatcatttctgatgtcagtgatccggtcctttggactttcgtaatcgtcttctctcgcctcaagtctacgcaacacgtcctccctgacccatccgccggcctccacgtctagacggacgacgctactagttattactgacagctacattactaccacccgagggctaacgttctcgtagtacgtacgttacgggcggacgggtacccttggccgttacggacccgttccgtaacggtccacggtaccccaacggg

SEQ ID NO: 376062 - DNA, 496 bp, Homo sapiens
  misc_feature: GZ8MTXP02I02GZ.10.72.G06.1.454.CMB.2.raw
  modified_base (304)..(304): a, c, t, g, unknown or other
  modified_base (416)..(416): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaagcccccagactcatcatttcngatgtcagtgatcggcctttggtatttctatcgcttctctgcctcagtctgcacacgcttcctgaccatctccggctccacgctgagacgagctacattacttatgcagctnatatacaccaggggcacgtctcgtgtatacgttcggcggacgggcctggctcggaccgtcctacgtcacgacccgaacgg

SEQ ID NO: 376063 - DNA, 493 bp, Homo sapiens
  misc_feature: GZ8MTXP02JJ434.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcattctgatgtcagtgatcggccctttgggactttctaatcgcttctctgcctcaagtctggcaacacgcttctctgaccatctccgggctccacgctgacgacgaggctcattatactgcagctcatataccaccgagggcactctcgtgattacgttcggcggaggacctggctcgaccgtctacgtcacgacccg

SEQ ID NO: 376064 - DNA, 501 bp, Homo sapiens
  misc_feature: GZ8MTXP02GMISY.10.72.G06.1.454.CMB.2.raw
  modified_base (242)..(242): a, c, t, g, unknown or other
  modified_base (364)..(364): a, c, t, g, unknown or other
  modified_base (451)..(451): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtncttataactatgtctcctggtaccaacaacacccaggccaggcccccagactcatcatttctgatgtcagtgatcggccctttgggactttctaatcgcttctctgcctcaagtctgcaacncggcttccctgacccatctccggctccacgctgaggacgaggctcattattactgtcagctcatactacaccgagggcactctcgtnactagttcggcggacggcctggctcgaccgtcctacgtcacgcccaacgg

SEQ ID NO: 376065 - DNA, 498 bp, Homo sapiens
  misc_feature: GZ8MTXP02JYCT9.10.72.G06.1.454.CMB.2.raw
tcagcatagtagtgcacgaccggtgctcgatttagctacgactgcaagggaaaggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcatttctgatgtcagtgatcggccctttgggactttctaatcgcttctctgcctccaagtctgcaacacggcttccctgaccatctccgggctccacgctgagacgaggctcattatactgcagctcatagtacacccgagggcactctacgtgacttagttcggcggacggcctggcttgacccgtcttacgcacgcccaacgg

SEQ ID NO: 376066 - DNA, 561 bp, Homo sapiens
  misc_feature: GZ8MTXP02H7Y4Y.10.72.G06.1.454.CMB.2.raw
  modified_base (371)..(371): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgtcttaataactatgtcctcctacggtaaccaaacaaccacccgacggccaccggaccccagacctcactctatttctagtactgtacagtgacgtcggtccgttggtacttctaatcgtcttctctcncctctaatcgtgacacgacgtcctccctcgacctacgtccgtccggcctccgacgcgtgacggacgtagcctactatttacttacgtgcagtctacatacacgaccgagggctacgtcgtacgtcgtacttacggtcggacgggacggtaccgtggccgtcgaccgtcgtaccgtcgacgtaccgaccgg

SEQ ID NO: 376067 - DNA, 521 bp, Homo sapiens
  misc_feature: GZ8MTXP02J3RKI.10.72.G06.1.454.CMB.2.raw
  modified_base (305)..(305): a, c, t, g, unknown or other
  modified_base (433)..(433): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacattaggtgcttataactatgtctcctggtaccaacaacacccaggccacggccccagactcatcatttcngatgtcagtgattcggccctttgggactttcgtatcgtcttctctgcctcaagtctgacacacgccttccctgaccactcgtcccgggctccgacgctgacggcgacggctctattacttactgacanctacatacacgacccaggggccacgtctgtcgatacgttcggcggaacggcctggctcggaccgtccttaacgccaacggcccaacgg

SEQ ID NO: 376068 - DNA, 558 bp, Homo sapiens
  misc_feature: GZ8MTXP02H5IJ7.10.72.G06.1.454.CMB.2.raw
  modified_base (394)..(394): a, c, t, g, unknown or other
  modified_base (448)..(448): a, c, t, g, unknown or other
tcagcatagtagtgcacgaccggtgctcgatttagctacgactgcaagggaaagggggggtctcaggaggcagcgctctcgggacgtctccaccatggcctggactctgctattcctcaccctcctcactcagggcacagggtcctgggcccagtctgccctgactcagcctgactccgtgtctgggtctcctggacagtcgatcactatctcctgcactggccacagcagtgacataggtgcttataactatgtctcctggtaaccaacaacaccagccacggccccagacctcatcattctgatgtcagtgacgtcgtcctttggacttctaatcgctttctctcgtccctcctaagtctacggacaaacgccgtccttccctacgaacctntccgtccgggcccttaccgacgctaggacggacgaggctctatttactttaacncgacatctactactactaccgaccgacggacgtacgtacgtcgtacgtacgtacgtacggacggacggtacgtcgtcgtcgtaccgtaccgtacgtacgaccgaccgacg

SEQ ID NO: 376069 - DNA, 545 bp, Homo sapiens
  misc_feature: GZ8MTXP02HBSS0.10.72.G06.1.454.CMB.2.raw
  modified_base (209)..(209): a, c, t, g, unknown or other
  modified_base (404)..(404): a, c, t, g, unknown or other
  modified_base (425)..(425): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactntccgtcctgcactggcaccagcagtgacataggtgcttataactatgtctctggtaccaacaacacccaggccacggcccccagactcatgtattttgatgtacagtaactcgcctcgtaggggtttcaacgtcgtcttctctggctccagtctggcaacgccgtctcctgaccatcctcgtcggctccgagtcngagacgagctgattagttacngacagtctacatactaaccaacgagacacgtacttactcgttaggtacgtacgggacggtacggaacctacggtcgtaaccggtaccgtacgtacggtaccgaccggaccgtacggtccg

SEQ ID NO: 376070 - DNA, 507 bp, Homo sapiens
  misc_feature: GZ8MTXP02FJ1XO.10.72.G06.1.454.CMB.2.raw
tcagcatagtagtgcacgaccggtgctcgatttagctacgactgcaagggaaaggggtctcaaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcacacggcttccctgaccatctccgggctcccacgctgaggacgaggctcatttacttactgcagctcatactacacctaggggcactctcgtgactattcggcggacgggaccgtggcgtcgaccgtccgtacgtcgacgcccaacgg

SEQ ID NO: 376071 - DNA, 644 bp, Homo sapiens
  misc_feature: GZ8MTXP02G29YT.10.72.G06.1.454.CMB.2.raw
  modified_base (315)..(315): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatctatttctgatgtcagtnatccggtcctttgggactttctaatcgtcttctctcgtccctcaacgttcctagggacctaaacgaccgggtcccttaccccgtgtaaccctactccgtcccggggtcctaccccgtacgtccgttggaacgggacgaacgggtccttaccgtaatttacgtttaaccgtcgccgtagtacctctaacttaactacccgacccgaggggacctaacgttccgtcgttagtaacgttacgtaccggggtaccgggtacggtaaccgttacgggcgttacccgggacccgttacccggtacggttaccgtaaccggaccccgtaaaccggg

SEQ ID NO: 376072 - DNA, 500 bp, Homo sapiens
  misc_feature: GZ8MTXP02HBQTS.10.72.G06.1.454.CMB.2.raw
  modified_base (373)..(373): a, c, t, g, unknown or other
  modified_base (426)..(426): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacaccaggccacggccccagactcatcatttctgatgtcagtgatcggccctttgggatttctaatcgcttctctgcctccaagtctgcaacaccgcttcccngaccatctccgggctccacgctgacggacgaggctcattattatgcagctcanatacacccagggcactctcgtgactagttcggcggacggaccgtggctcgaccgtcctacgtcacgaccaacgg

SEQ ID NO: 376073 - DNA, 510 bp, Homo sapiens
  misc_feature: GZ8MTXP02J1EUC.10.72.G06.1.454.CMB.2.raw
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgcttctctgcctccaagtctggcaacacggtctccctgaccatctccgggctcacgctgagacgacggctcacttatactgacagctcaatactaccacccgaggggctactctacgtgactattcggcggacggacctggcgtcgacccgtctaccgtcgacgcccaacgg

SEQ ID NO: 376074 - DNA, 679 bp, Homo sapiens
  misc_feature: GZ8MTXP02JMLHK.10.72.G06.1.454.CMB.2.raw
  modified_base (269)..(269): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctccgtgggcagtcagtcaccatctcctgcactggaaccagcagtgatggttggtgttatgtacttgtctctgtaccaangcagcagcaacgccccaaatcatgatttatgatgtcagtcgcgccggcccgtcggggtcctgtactcgtcttctcgtcggcctccgagtcgtacgaccaaccgtccggtccctccctacgacctactcccgtcgtccggtccctccacggtcctagggaacgtacgtcggtaagggtcttaggttaacttttacgttaccgttgggtttaccgtaccgttaacgtagttacgtacggaccgggttacgggggttacccgggttaccgggtttcggggtttacgggggttacggggttaccgggggtaacgggggtaaaccgggtaacccgtaacggtcccggttaaccggtaaccccggttacggtaccgggtaccgtacccggtacccggtaaccggtcccgtccccgg

SEQ ID NO: 376075 - DNA, 535 bp, Homo sapiens
  misc_feature: GZ8MTXP02GJA0S.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcatttctgatgtcagtgatcggtccctttgggactttcgtaaatcgtcttctctcgcctcgagtctggccaaacacggcttccctgacccatcctccgggctcccgacgctgacggacgacggctacattacttactgcagcctacatataccaccgaggggcactctcgtgactacgttcgggcggaacggccctggcgtacggacccgttaccgtaccgtacgacgcccgaaaccgg

SEQ ID NO: 376076 - DNA, 495 bp, Homo sapiens
  misc_feature: GZ8MTXP02JD5NY.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcatttctgatgtcagtgatcggccctttggactttcaatcgctttctctgcctcaagtctgcaacacggcttcctgaccatctccgggctccacgctgacgacgaggctcgattattactgcagctcatatacacccgagggcacgtctcgtcgatagttcggcggacggactggcgtcgaccgtcacgtcacgccaacgg

SEQ ID NO: 376077 - DNA, 506 bp, Homo sapiens
  misc_feature: GZ8MTXP02GMEVE.10.72.G06.1.454.CMB.2.raw
  modified_base (373)..(373): a, c, t, g, unknown or other
  modified_base (425)..(425): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatcatttctgatgtcagtgatcggcctttggactttctaatcgcttctctgcctcagtctgccacgcggtcttcccngaccatcctccgggctcccgacgcgtagacggacgaggctacattacttacngcagctcatactacaccgtagggcactctcgtgactgtcggcggacggactggcgtcgaccgtcctacgtcacgtccacgg

SEQ ID NO: 376078 - DNA, 517 bp, Homo sapiens
  misc_feature: GZ8MTXP02GNAQ5.10.72.G06.1.454.CMB.2.raw
  modified_base (302)..(302): a, c, t, g, unknown or other
  modified_base (357)..(357): a, c, t, g, unknown or other
  modified_base (365)..(365): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttcngatgtcagtgatcggcctttgggactttctatcgcttctctgcctcatctgcacncgtctccngaccatcgtccggctccgacgctgaggacgaggctactattacttactgcagctacatactacaccgagggccactctcgtgtacgtacgttcgggacggtacgggccgtggccgtcggtaccgtcccgtacgtaccgacgacccgtaacgg

SEQ ID NO: 376079 - DNA, 590 bp, Homo sapiens
  misc_feature: GZ8MTXP02FZIEF.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttaataactatgtctctggtaccaacaacacccaggccaggcccccagactcatcatttctgatgtcagtgactccggtccctttgggtactttactaatcgtcttctctcgcctaccaagtctgcaacacggtcttccctgaccctatccgtccgggcctccgacgtcgtaggacggacgacggctactattactactcgacagctcatactaccgacccgaggggactaacgttccgtacgtgtaacgttacggttccggggacgggtaacgggtaccgttcgggaaccgttaccgggtaaccccgttccgtaaccggtacgaacccggtacccgtaaacccgggg

SEQ ID NO: 376080 - DNA, 541 bp, Homo sapiens
  misc_feature: GZ8MTXP02GEGD5.10.72.G06.1.454.CMB.2.raw
  modified_base (299)..(299): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttatactatgtctctgtaccaacaacaccacggccggccccagactcatcatttcngatgtcagtgatccggcctttggactttcgtaatcgcttctctcgctccaagtctggcaacgcgtcttccctgacctatccgtccggctcccacgctggacggacgagctacattatacgtgcagtctacatactaccgaccgacgggtcacgttcgtcgtagacttacgttcgggacggtacgggaccgtggtacctcggaaccccgttccgtacggtaccaccggacccgaacggtcccg

SEQ ID NO: 376081 - DNA, 695 bp, Homo sapiens
  misc_feature: GZ8MTXP02FWKGR.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctgtaccaacaaccaccagccacgcccccagactcatctatttctgatgtcagtgagtcggtccgtttgggtactttctaatcgtctttctctcgtcctaccgtaaagttcctcgacctaaaccgaccgggtccctttaccccgtcgtaacccctaacgttcccgttccccggggccttccccgaccggtaccgttcgggaaccgggtaccggacgggtaccttacctaaacttttaacgtttaaccgtcgtaccgtacgtaccctacttaacttaacttaaccgaaccccggtaacgggggtaccctaccgttaccgttcggttacgtaacgtttaaacggtttccggggacgggtaaaccggggtcccggttagggtcccgttacggtaccccggttacccgtaaccggttccgtaaccggaccccgtaaacccgggg

SEQ ID NO: 376082 - DNA, 527 bp, Homo sapiens
  misc_feature: GZ8MTXP02HOPZZ.10.72.G06.1.454.CMB.2.raw
  modified_base (301)..(301): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacacccaggcaaagcccccaaactcatcatttcngatgtcagtgatcggcctttgggatttcgtaatcgccttctctcgcctcaagtctggcaacacggcttcctgaccatctccggctccacgctgacggtacgaggctcattacttactgcagtctacatataccaccgagggcacgtctcgtgattacgttcgggcggacggaccgtggacctcgacccgtcctaacgtcacgacccgaaggcctcgtccccctcgg

SEQ ID NO: 376083 - DNA, 565 bp, Homo sapiens
  misc_feature: GZ8MTXP02H01BP.10.72.G06.1.454.CMB.2.raw
  modified_base (372)..(372): a, c, t, g, unknown or other
  modified_base (381)..(381): a, c, t, g, unknown or other
  modified_base (427)..(427): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactggcacagcagtgacataggtgcttataactatgtctctcggtaccaacaacaccacggccacggccccagactcatcattctgatgtcagtgacgtcggtcctttggtactttctaatcgcttctctcgcctacgatctgacaacgcgtcttccngaccatccnccggctccgacgtcagacggcgtaacgcttcgtaatttacgttacncgacacgtctactaactacgacccgaaccggtacggtacctacgttcgtacggtagtacgttacgggtaccgggacgggtacggtaccgtcggtaaccgtaccgtacccgtccgtaccgtaccgaccggtacccgacg

SEQ ID NO: 376084 - DNA, 605 bp, Homo sapiens
  misc_feature: GZ8MTXP02IGSII.10.72.G06.1.454.CMB.2.raw
  modified_base (439)..(439): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatccggtcctttggactttctaatcgctttctctcgtcctccaagtctggccaacacgccttccctgacctatccgtccgggctccacgctgacggacgaggctcgtaattacttactcgacgancctactactattaccgaacccgagggggtacctaaccgttcgttacgttacggtaacttacgggttaccgggtaccggggtaacggggtacccgttacggggtcccgttacggaacccggtttacccgtaaccggtttacccgaacggacccccgtaaacccgggg

SEQ ID NO: 376085 - DNA, 565 bp, Homo sapiens
  misc_feature: GZ8MTXP02ILGU6.10.72.G06.1.454.CMB.2.raw
  modified_base (301)..(301): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccagccacggccccagactcatcatttcngatgtcagtgatcggcctttgggactttcgtaatcgtcttctctcgcctcaagtctggcaacacggcttccctgacccatcgtccgggctccacgctgagacgagctcattattacctgctagctacatactaaccacccgagggggcaaccgttcgtaccgttgacgttaacgttcgggacggggaaacggggtaccccgttggggccgtacggtaaccccgttcccgtaaaccggttcccgacggaccccgtaaacccgggg

SEQ ID NO: 376086 - DNA, 510 bp, Homo sapiens
  misc_feature: GZ8MTXP02J01MN.10.72.G06.1.454.CMB.2.raw
  modified_base (459)..(459): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcctttgggactttctaatcgtcttctctcgcctcaagtctgcaacacgctccctgaccatctccggctccacgcctgacggacgaggtctactattactactgactagctcagtactacacccgagggccacgtctcgtnatacgtcggacggacggactggcgtcgaccgtctacggtcacggccaacgg

SEQ ID NO: 376087 - DNA, 535 bp, Homo sapiens
  misc_feature: GZ8MTXP02GT178.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggtccctttgggactttctaatcgtcttctcttcgcctctaagtctagaccacacggtccttccctcgaccatccgtccgggctccgacggctcggaggaccgaggtctggtaattattactgtacagcttacattacacaacagacagtctacttctcgttacgttcgggacgggacggacgaagcgtcgaccgtccacggtacacggacccaacgg

SEQ ID NO: 376088 - DNA, 533 bp, Homo sapiens
  misc_feature: GZ8MTXP02FWJV4.10.72.G06.1.454.CMB.2.raw
  modified_base (323)..(323): a, c, t, g, unknown or other
  modified_base (407)..(407): a, c, t, g, unknown or other
  modified_base (418)..(418): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatgtattttgatgtcagtaatcgccctnaggggtttctaatcgtcttctctggctaccagtctggcaacacgctccctgaccatctctgggctcgaggctgaggacgacggntagtattatcngacacgtactacaataactaacaacgagacagtactacgttcgtagttacgtacgggacggaacggaaccagtccgtaacgtacccgtacgtacggacgacgacccgacggtccg

SEQ ID NO: 376089 - DNA, 665 bp, Homo sapiens
  misc_feature: GZ8MTXP02JXZRZ.10.72.G06.1.454.CMB.2.raw
  modified_base (353)..(353): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagacctcatcattctgatgtcagtgatccggtcctttgggactttcgtaatcgtcttctctcncctaccaagttctaggaccaacgaccggtcctttacccgtgtacccaacgttcccgttcccggggccttcccgaccggtccgttagggaacgggaacggacgggtaccttaccgtaaagtttacttaaccgttacgccgtaacgtccttacgaacttacgtaaacccaccccggagggggtaccaaccgtttccgtccggttagtaaacgttacgttaccgggggtaccgggaaacggggtaccccggttaggggcccttacggtaccccggttacccgtaaccggttccgtacccggaccccgtaaccggg

SEQ ID NO: 376090 - DNA, 506 bp, Homo sapiens
  misc_feature: GZ8MTXP02HE0NI.10.72.G06.1.454.CMB.2.raw
  modified_base (413)..(413): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcattctgatgtcagtgatcgccctttggactttctaatcgcttctctgcctccaagtctgcaacacgctccctgaccatctccggctccacgctgagacgaggctctattatttacngcagctacatacacgaccgaggctactctcgtagtactacgtcggacggacggtctcggcgtacgaccgtccgtacgtaccgacgaccgaacg

SEQ ID NO: 376091 - DNA, 514 bp, Homo sapiens
  misc_feature: GZ8MTXP02G3DRP.10.72.G06.1.454.CMB.2.raw
  modified_base (454)..(454): a, c, t, g, unknown or other
tcagcatagtagtgcacgaccggtgctcgatttagctacgactgcaagggaaagggggggtctcaggaggcagcgctctcgggacgtcaccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctgtaccaacacaccaggccaggcccccagactcatcatttctgatgtcagtgatcggcctttggtactttctaatcgcttctctcgcctcaagtctgcaacacggtccttccctgacccatccgtccgggctccacgctggacgcgaggctctattattactgctagctcatactacaccgagggcacgtctcgtnatacgtcggacggtacggaccgtggccgtacgaccgtcctacgtcgacgtacccgaacgg

SEQ ID NO: 376092 - DNA, 536 bp, Homo sapiens
  misc_feature: GZ8MTXP02IIAFV.10.72.G06.1.454.CMB.2.raw
  modified_base (366)..(366): a, c, t, g, unknown or other
  modified_base (376)..(376): a, c, t, g, unknown or other
  modified_base (409)..(409): a, c, t, g, unknown or other
  modified_base (434)..(434): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacaccaggccacggcccccagactcatcatttctgatgtcagtgatcggtcctttgggtactttctaatcgcttctctcgcctcaatctgccaacncgtcttcccngaccatccgtaccggctccacgctgacggacgnggctccgtattacttactgcagctnatactaccaccgacggggcacgtcgtcgtagacttaacgtcgggacggaacgggtccgtacggcgtacggtaccgtccgtacgtccacggacccgaaaccgg

SEQ ID NO: 376093 - DNA, 723 bp, Homo sapiens
  misc_feature: GZ8MTXP02GKPMO.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttaataactatgtctcctaggtaccaacaacacccaggccacggccccagactcatcatttctgatgtcagtcgacgtccggtccgtttgggtactttactaacgtcgtcttctctcgtccctacctaaagttccgtcggaccaaacgtccggtccctttacccgtcgtaaccctacgttcccgtcccggggtcccttaccccgaccggtacgttacggaacgggtaccgacgggttaccttacgtaaagttttaacctttaacgcgtacgtacgtacccttactaacgtttaactaaccccgaacccgggacggggtaccctaaccgttccgttaccggttacggtaaacgtttaccggttaccgggggaccgggggtaaaaccgggttcccgttaacggggtcccgttaacccgggtacccccggttaacccgtttaaccggtacccgtaacccggtaacccccggtaacccggggg

SEQ ID NO: 376094 - DNA, 620 bp, Homo sapiens
  misc_feature: GZ8MTXP02GD1DZ.10.72.G06.1.454.CMB.2.raw
  modified_base (315)..(315): a, c, t, g, unknown or other
  modified_base (352)..(352): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttaataactatgtctctggtaccaacaaccaccagccacgccccagacctcatcatttctgatgtcagtnagtcggcctttgggacttttctaatcgtcttctctcncctccaagtctgacaacgacgtccttccctagaccctactccgtccgggccctcccgacgtacgtaggacggacgacggccttacctaatttaacttacgtcggtacactacctacaacttaactaaccgacccgaacggggtacctaaccggttccttacggtagttacgttacggtttaccgggacgggtaaccgggtaaccgtgggtaaccgttaccgtaacccggttacccgtacccggttacaaccggacccgtaaacccggg

SEQ ID NO: 376095 - DNA, 554 bp, Homo sapiens
  misc_feature: GZ8MTXP02I6WY3.10.72.G06.1.454.CMB.2.raw
  modified_base (389)..(389): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccagccaggccccagactcatcatttctgatgtcagtgactcggtcctttggactttctaatcgtcttctctcgtcctcctaagtccttgggaccaacgaccgggtcctttcccncgtacccacttccgtcccgggcctcccaccgcgtaggacggacgaggctactagttacttactgcagctacatactaccaccgacgggccactcgtcgtcgacttacgttcggcggaacggccgtaggcgtcggaccgttccgtacgtccgacgcccgtaaccgg

SEQ ID NO: 376096 - DNA, 628 bp, Homo sapiens
  misc_feature: GZ8MTXP02JQFYD.10.72.G06.1.454.CMB.2.raw
  modified_base (388)..(388): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttaataactatgtctctgtaccaacaacacccaggccacggccccagactcatctatttctgatgtctagtgtacgtccggtccgtttggtacctttctaactcgtcttctctcgtcctcagtccgtgaccacgacgtccttcccngaccctactccgtccggcctaccgacgcgtacggacggacgtacggtacctctaatttacttacgtcgaccacgtctacgtaactaaccttaacccgaacccggacggggtaccaccgttccgtacggttacgtaacgtttacggttaccggggaccggggtaaaccggggtaccgtacgggtccgtaccggtaacccggttcccgtaaccggttccgaaccggaccccggtaacccggg

SEQ ID NO: 376097 - DNA, 581 bp, Homo sapiens
  misc_feature: GZ8MTXP02JI31V.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatcatttctgatgtcagtgactccggtccgtttggtactttctaatcgtcttctctcgtcctacaagtctacgacaacgtacggtccttccctcgacccactcgtccgggcctccacgctaggacggacgacggtctacgtattacttacgtcgacagtctacattactaaccgacccggagggcctaaccgtcgtcgtagacgttacgttacgggacgggtacggaccgtcggtcgtaccggtacccgttacccggtacgtccgaccggtacccgtaaccggg

SEQ ID NO: 376098 - DNA, 587 bp, Homo sapiens
  misc_feature: GZ8MTXP02HU7E2.10.72.G06.1.454.CMB.2.raw
  modified_base (240)..(240): a, c, t, g, unknown or other
  modified_base (299)..(299): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtncttataactatgtctctgtaccaacaacacccaggccaggccccagactcatcatttcngatgtcagtgatcggtcctttggactttctatcgcttctctgcctcagtctgcacacgtctcctgacccatccgtccgggctcccgacgctcgacggacgaggtctccgtatttacttactggaccacgtcctacaatttacaaccgacccgaggggaccctaccgtcgttccgtagtaacgttacggtttaccggggacggggtacggggtaacccgtgggtaacccgttccgggaacccggttacccgtaccgggtttacccgaccggtaccccgtaaacccgggg

SEQ ID NO: 376099 - DNA, 618 bp, Homo sapiens
  misc_feature: GZ8MTXP02JWSUK.10.72.G06.1.454.CMB.2.raw
  modified_base (310)..(310): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgactagtaggtgcttataactatgtctcctgtaccaacaaccacccaggccacggcccccagacctcactcatttcngatgtcagtgatcggtccgtttaggactttctaatcgtacttctctcgcctacaagtcgtggacaacgtaccggtccttcccgtagaccctacgttcccgtcccgggcctcccgacgcgtacggaacgggacgacggtcctacgtaactttaacttacgtacgtaccgagtacctacctaaactaacgtaacccgacccggtaaggggccctaacgtccgtacgtacgtacgttaacgttccggggacggggacgggtaccgtacgggcgtacgacccgtaccgtacgtaccgaccgacccgaacggg

SEQ ID NO: 376100 - DNA, 544 bp, Homo sapiens
  misc_feature: GZ8MTXP02GYJG5.10.72.G06.1.454.CMB.2.raw
  modified_base (424)..(424): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatcatttctgatgtcagtgatccggtccgtttgggactttctaatcgtcttctcctgcctcctaagtctcgacaacgaccggtccttcctcgacccatccgtccggctctacgctgacgacgacgctntaattacttactgtcagctacatactaccaccgacggggctacttcgtacgtagacttacgtacggtcggacggtacctcggcgtcgacccgttccaacggtccaacggtccctaaccgg

SEQ ID NO: 376101 - DNA, 572 bp, Homo sapiens
  misc_feature: GZ8MTXP02F1U6D.10.72.G06.1.454.CMB.2.raw
  modified_base (334)..(334): a, c, t, g, unknown or other
  modified_base (428)..(428): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccggccccagactcatcatttctgatgtcagtgatcgtcctttggatttcatcgnttctctcgcctccaagtctggccaacgcggccttccctagacctatccgtccgggctccacgcctggacggacgaggcttacgtattagttacngcagtctacatactaccgaccgtaagggcctacttcgtcgtacgtattacggtttccgggacggggtacgggtacccgtcgggtacgtaaccgtaccccggttccttaaaccggccgtaaccggccccggaacggttcccccgg

SEQ ID NO: 376102 - DNA, 518 bp, Homo sapiens
  misc_feature: GZ8MTXP02I8I51.10.72.G06.1.454.CMB.2.raw
  modified_base (198)..(198): a, c, t, g, unknown or other
  modified_base (375)..(375): a, c, t, g, unknown or other
  modified_base (419)..(419): a, c, t, g, unknown or other
  modified_base (450)..(450): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacngtcgatcactatctcctgcactggcaccagcagtgacataggtgcttataactatgtctcctggtaccaacaacacccaggccaagcccccagactcatcatttctgatgtcagtgatcggcctttggtactttctatcgtcttctctcgcctccaagtctgcaacacggcttcccngaccatcctcgggctccacgctgacgacgaggctcattattacngcagctcatactacaccctaggggcaactcncgtagacttagttcggcggaacggtccgtggaactcggacccgtcgtaacgtccgacgcccgtaacgg

SEQ ID NO: 376103 - DNA, 546 bp, Homo sapiens
  misc_feature: GZ8MTXP02IBS7X.10.72.G06.1.454.CMB.2.raw
  modified_base (228)..(228): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatcctcctgcactggaaccngcagtgatgttggtgttatgtactttgtctcctggtaccaacagcagccaggcgaacgcccccaaattcaatgatttatgatgtcagtgcgccggcccgtcggggtccctgactcgcttctctcggctccagtctggcaaccgacggcctccctgaccatctctcggccctaccagcctagacgatcgaggctagtatttattactgttcgctcatatcgcgaggtccgtacgtcggttggggtcggttcgggacgggacgggaccgaagtccgtacgtaacccgtcgtaacggtcaacggccctaacggctccccgg

SEQ ID NO: 376104 - DNA, 613 bp, Homo sapiens
  misc_feature: GZ8MTXP02G15ZW.10.72.G06.1.454.CMB.2.raw
  modified_base (206)..(206): a, c, t, g, unknown or other
  modified_base (239)..(239): a, c, t, g, unknown or other
  modified_base (316)..(316): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactntctcctgcactggcacagcagtgacagtaggtnacttaataactatgtcctcctaggtaaccaacaaccacccgacggacccacggacccccagacctcactctatttcngatgtacagtgacgtccggtccgtttggtactttctagtctcttctctctcctacaacgtctacgaccaacgtccgtcttccctagacctagtcccgtccggcctccgacgtcgtacggacggacgacgcctactaatttacttacgtcgacctacgtcctataacttaacgaacccgaccggacgggtaccctacgttaccgtcggtagttaaacgttacggttccggggaccgggtacggtaccgtggtaaccgtccggtacccgttacgtaccgacgaccggtacccgaaccgg

SEQ ID NO: 376105 - DNA, 529 bp, Homo sapiens
  misc_feature: GZ8MTXP02H2IXU.10.72.G06.1.454.CMB.2.raw
  modified_base (377)..(377): a, c, t, g, unknown or other
  modified_base (384)..(384): a, c, t, g, unknown or other
  modified_base (395)..(395): a, c, t, g, unknown or other
  modified_base (405)..(405): a, c, t, g, unknown or other
  modified_base (418)..(418): a, c, t, g, unknown or other
  modified_base (424)..(424): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcacactcctcactcagggcacagggtcctgggcccagtctgccctgactcagcctgactccgtgtctgggtctcctggacagtcatcactatctcctgcactggcaccagtcagtgagatacggtgacttataactatgtctcctggtaccaacaacaccaggccaggcccccagctcatcattctgatgtcagtgatcggtcctttgggatttacgtaatcgtcttctctgaccttcaacgtctggacacacgcttccnaccatcncggctcacgcngagcaggctnattatactgctanctacanactaccgacgacggactacgtacgtcgtacgtacgttacggtaccggacgggtacggtaccgtcggtacgtacggtacccgtaccgtaccgtaccgaaccgaccg

SEQ ID NO: 376106 - DNA, 591 bp, Homo sapiens
  misc_feature: GZ8MTXP02ILUE6.10.72.G06.1.454.CMB.2.raw
  modified_base (216)..(217): a, c, t, g, unknown or other
  modified_base (228)..(228): a, c, t, g, unknown or other
  modified_base (318)..(318): a, c, t, g, unknown or other
  modified_base (429)..(429): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtcgtggtcctcctggacagtcgatcactatctccnncactggcaccngcagtgactagtaggtcgacttataactatgtctccgtgtaccaaacaaccaccacgccacggccccagactcatgtattttgatcgtanagtacgtccggtacctgtacggggtttctaacgtcgtcttctcgtgcctcagtctgacactaccgcctcctgacctatcctcgtcggctcccgagtcgtcgaggtaacggngtctagtattatacgtgactacgtctactaactactaaccgaacgtacgacacgtacgttacgttacgttacggttacggtaccgggaacggtaacggtaaccgtaagtccggtaaccgtaccgttaccggtacgtaccgtaccgtaacccgtacggtcccg

SEQ ID NO: 376107 - DNA, 502 bp, Homo sapiens
  misc_feature: GZ8MTXP02H0GU0.10.72.G06.1.454.CMB.2.raw
  modified_base (369)..(369): a, c, t, g, unknown or other
  modified_base (448)..(448): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacacccaggccaggcccccagactcatcatttctgatgtcagtgatcggccctttgggactttctaatcgcttctctgcctcagtctgcacacgcttccngaccatcgtccgggcttccacgctgagacgaggctcatttattactgctagctcatactacaccgagggcactctcgtnactgtacggcggacggacctggctcggacctaccgtacgtcacgacccgaacgg

SEQ ID NO: 376108 - DNA, 524 bp, Homo sapiens
  misc_feature: GZ8MTXP02I5DVW.10.72.G06.1.454.CMB.2.raw
  modified_base (376)..(376): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatcatttctgatgtcagtgatcggcctttgggactttctaatcgtcttctctgcctccaagtctggcaacacgcttcccngacccatctccggctcacgctgagacgaggctctattacttactgcagcctacatactaacacccgaggggcacgtctcggtatactacgttcgggaccggacgggtacctgggctcggaccgtccgtacgtcaacgcccgtaaacgg

SEQ ID NO: 376109 - DNA, 595 bp, Homo sapiens
  misc_feature: GZ8MTXP02G0BN7.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacacccaggccacggccccagactcatcatttctgatgtcagtgatcggtccgtttggtactttcgtaatcgtctttcgtctcgcctcaagtctacgtaccaactacggtccttccctacgaccctctccgtcccgggtcctacccgaccgcgtacggacggaccgacggtctacctaattacgttaacctgaccgatcctactacgtaactaaccgaaccccggaggggtacctacgtcgtccgtagtacgttagttccgggacgggaacgggtcctacggccgtacggtacccgtccgtaaccgtccgacgacccgtaaccgg

SEQ ID NO: 376110 - DNA, 551 bp, Homo sapiens
  misc_feature: GZ8MTXP02JHL9S.10.72.G06.1.454.CMB.2.raw
  modified_base (228)..(228): a, c, t, g, unknown or other
  modified_base (349)..(349): a, c, t, g, unknown or other
  modified_base (370)..(370): a, c, t, g, unknown or other
  modified_base (381)..(381): a, c, t, g, unknown or other
  modified_base (450)..(450): a, c, t, g, unknown or other
  modified_base (454)..(454): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctccgtgggcagtcagtcaccatctcctgcatggaaccngcagtgattggttggtgttatgtactttgtctcctggtaccaacagcagccgaggcgaacgccccaaatcatgatttatgatgtcagtgcgccggtccgtcggggtcctgctcgtcttctncgctcagtcgtcggaccaacnccggccctccncgaccctatctcgcggtccctcgacgcctaggacgatcggaacgtctagtactttaagttcttggtacnctanatagtcgacgtaggtccgtacgtcggttgggtcgtcgggacggtacggaccagccgtacgaaccgtcgtacgccgacgacccgtacggcctccccgg

SEQ ID NO: 376111 - DNA, 510 bp, Homo sapiens
  misc_feature: GZ8MTXP02ISJ2J.10.72.G06.1.454.CMB.2.raw
  modified_base (371)..(371): a, c, t, g, unknown or other
  modified_base (437)..(437): a, c, t, g, unknown or other
  modified_base (452)..(452): a, c, t, g, unknown or other
  modified_base (457)..(457): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacaccccaggccaggcccccagactcatcatttctgatgtcagtgatcggccctttgggatttctaatcgcttctctcgcctccaatctgcacacggcttccngaccatctccgggctccacgctgaggacgaggctctagttattactgtcaagcctcatactaaccnccgaggggcacttcncgtanactattcgggcgacggcctggaacgtcgaccgttcctacgtcacgacctacgg

SEQ ID NO: 376112 - DNA, 493 bp, Homo sapiens
  misc_feature: GZ8MTXP02GNGW4.10.72.G06.1.454.CMB.2.raw
  modified_base (311)..(311): a, c, t, g, unknown or other
  modified_base (371)..(371): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacacacccaggccaggccccagactcatcatttctgatgtcagtnatcggccctttgggatttctaatcgcttctctgcctccaagtctgcaacacggcttcccngaccatctccggctccacgctgacgacgagctcattattactgcagctcatatacaccagggcactctcgtgatacgttcggcggaggaccgtggctcgaccgtcctaggtcacgccaacgg

SEQ ID NO: 376113 - DNA, 551 bp, Homo sapiens
  misc_feature: GZ8MTXP02F1EUF.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacacccaggccacggcccccagactcatcatttctgatgtcagtgacgtcggtcccgtttgggtactttctaatcgtcttctctgtcctccaagtctcgacaacaccggtcttccctgacccatccgtccggctccgacgctaggacggacgaggtctacgatttactactgacagcctacatacgtaccacccgaggggcctactcgtcgtagacgttagttcggcggaacggccgtacggcgtcgaccgttccgtaacgtccgtacggaccctaaccgg

SEQ ID NO: 376114 - DNA, 539 bp, Homo sapiens
  misc_feature: GZ8MTXP02FIVD4.10.72.G06.1.454.CMB.2.raw
  modified_base (319)..(319): a, c, t, g, unknown or other
  modified_base (420)..(420): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacacccaggcaaagcccccaaactcatgattttgatgtcagtaatcggccctnagggtttctaatcgcttctctgctcagtctggcacacgcctcctgacctatctctcgggctcccgaggctagaggacgaggctagtattatactgcagctnatatacaaccagcaagcacttctgtacgttcgggcggacgggtaacacgtctacggtaccgtaccgttaaggccacggtaccccaaacgggtccgtacccggcccccgttcggtacccc

SEQ ID NO: 376115 - DNA, 638 bp, Homo sapiens
  misc_feature: GZ8MTXP02G1V8Q.10.72.G06.1.454.CMB.2.raw
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactggcaccagcagtgacagttaggtgtacttaataactatgtctcgtgtaccaacaaccaccgacggccacggccccagactcatgtattttgatgtacaagttactccggtacctcgtaggtttctaacgtcgtcttctctgcctacagtctgactaccgaccgtcctaccacgtacctattccgtcgtcgggtccacccgtaggtccgtaggaacggacggacggtctaggttaactttacttacgtgactagtacctactaaattaactaacaaacccggaacgtaccgtaacgtaccttacgtttacggttacgttacggttaccggggaaccgggtaaaccggtaaccaacggtacccgtaaccggtaacccgtaccggtaccggtacccgaccggtacccggtaacggtcccg

SEQ ID NO: 376116 - DNA, 578 bp, Homo sapiens
  misc_feature: GZ8MTXP02FSHPG.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaacgccccagactcatcatttctgatgtcagtgatcggtcctttggtactttctaatcgtcttctctcgtcctacaacgttctacggacctaaacgccggtccttccctacgaccctacgtccgtccgggcctcccgacgtcgtaggacggacgaggtctactaatttacttactgcagtcctactaactactaccgaccgagggtctacgtcgtcgtagtacgttacggttacgggacgggtacggaccgttcggccgtcggaccgttaccgtacgtaccgaccgaccgtaaccgg

SEQ ID NO: 376117 - DNA, 606 bp, Homo sapiens
  misc_feature: GZ8MTXP02GUKRO.10.72.G06.1.454.CMB.2.raw
  modified_base (313)..(313): a, c, t, g, unknown or other
  modified_base (364)..(364): a, c, t, g, unknown or other
  modified_base (371)..(371): a, c, t, g, unknown or other
  modified_base (375)..(375): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggccccagactcatcattctgatgtcagtnatcggtcctttggactttctaatcgtcttctctcgcctcaagtctgcaacncgctccnaccnctcgtccggctccacgctagacggtacgaacggtctacgtatttacttacgtagactacgccttacaatttacaccgaacccggaggggtcctaaccgttaccgtccggttggtaaacgttacggtttaccggggaccgggtaaaccggggtacccgttcggggtaaccgtaccgggttaaccccggtaccgttaaaccggttcccaaccgggacccccgtaaacccgggg

SEQ ID NO: 376118 - DNA, 716 bp, Homo sapiens
  misc_feature: GZ8MTXP02GJ07M.10.72.G06.1.454.CMB.2.raw
  modified_base (320)..(320): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgacctccgtgtcgtgggtcctccgtggacagtcgatccacttatcctcctgcactggacaccagcagtcgactagtaggtgtacttaataactatcgtctctacggtaccaacaaccaccgacggaccaccggccccagactcactnttatttcgatcgtagtagtaacgtccggtccctggtacgggtttactaaccgtccgtcttctacgtcggtacctacgtacgtcgtcggaccaaccgtccggtccctacccgtacgacctacgttccgtcggtacgggtccttcccgacggtcgttacggaacgggtacggacgtccgtaaggttacttaaacgtttcgtacggtacacggtaccttaacgaaacgttaacctaacgaaaaccgcgaaccggaacgtcccttaaacgttttacggtacggttaaccggtttaccgggggaccgggaaaccgggggtaaccaaacggtacccggtaaccggtaccccgttaacgggtaccgttaaccgacccggttaccggtaacccggttcccccgg

SEQ ID NO: 376119 - DNA, 546 bp, Homo sapiens
  misc_feature: GZ8MTXP02IO9T5.10.72.G06.1.454.CMB.2.raw
  modified_base (301)..(301): a, c, t, g, unknown or other
  modified_base (383)..(383): a, c, t, g, unknown or other
  modified_base (422)..(423): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataacttatgtctcctgtaccaacaacacccagccacggccccagactcatcatttcngatgtcagtgactcggcctttgggtactttctaatcgtctttctctgcctctagtctggacaacgacgtccttcctgacctntccgtccggctccacgctgacgcgagctctattacttcnncagtcactatactacgacccgagggctacgtcgtacgtaggacttacggttcggacgggtacgggaccgttgggaaccgttacgacccggttaccctacgtaccgaccgacccggtaaccggg

SEQ ID NO: 376120 - DNA, 502 bp, Homo sapiens
  misc_feature: GZ8MTXP02FOW4R.10.72.G06.1.454.CMB.2.raw
  modified_base (256)..(256): a, c, t, g, unknown or other
  modified_base (401)..(401): a, c, t, g, unknown or other
  modified_base (426)..(426): a, c, t, g, unknown or other
  modified_base (431)..(431): a, c, t, g, unknown or other
tcagcatagtagtgcacgaccggtgctcgattagctacgactgcaaggggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggcaccagcagtgacataggtgcttataactatgtcncctggtaccaacaacacccaaggccaggcccccagactcatcatttctgatgtcagtgatcggccctttgggactttcgtaaatcgctttctctgcctccaaagtctggcaacacgcttccctgaccatctcggctccacgctgngacgaggctcatattactgcagctnattanacaccacggggcactctcgtgtataattcggcggacggactcggctgaaccgtcacgtcaagcccaaacgg

SEQ ID NO: 376121 - DNA, 613 bp, Homo sapiens
  misc_feature: GZ8MTXP02I7CWK.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctggtctccgtggacagtcgatcactatctcctgcactggcaccagcagtgacataggtgcttataactatgtctctggtaccaacaacaccagccacggccccagactcatgtacttttgatgtacagtaatccggcctagagggtttcaacgtcgtctctcgtgctcagtctggactaaacgccggtacctcctacgacctatcctcgtcgggtcctccgtaggcctaggacggacggaggctaggtatttattacgtgaccctaggtactacctaattaacctaacgaaacccaggacaacgtaccctaacgtttacgttacggtaacgtttaccggggaacgggtacggggaaaccctaacggtccgtaaccggtaaccgttacccggttaacggtacccgtaacggacccgtaaacgggtcccccg

SEQ ID NO: 376122 - DNA, 642 bp, Homo sapiens
  misc_feature: GZ8MTXP02IKQP2.10.72.G06.1.454.CMB.2.raw
  modified_base (274)..(274): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttataactatgtctctgtacaacacaccngccacgccccagctcatctatttctgatgtcagtgacgtccggtccgtttgggtactttactaacttccgtctttcttcctcgtcccttaccgtaaacgttccgtacgggaccctaaccgtacgggttcccttacccgtcgaaccctacgtcccgtccggggtacccttcccgaccgcgtcggaacggaccgaggtacccttacttaactttacgttaccttggaccacgtcctactacgtactaacccgacccgagggaccctacgttcgtcgtactacgttacggttcggggcggtaaacgggtaccgtcggtaaccgtaccggtacccgttaccgacggttacccgaaccggacccgtaaaccgg

SEQ ID NO: 376123 - DNA, 545 bp, Homo sapiens
  misc_feature: GZ8MTXP02GBU6U.10.72.G06.1.454.CMB.2.raw
  modified_base (429)..(429): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacacccagccacggcccccagactcatcatttctgatgtcagtgatcggcctttggactttctaatcgtcttctctgcctcaagtctgacaacgacgtccttccctgacccatccgtccggctccacgtctcgagacgagctacattattactgactagctnatactacacccgagggctactcgtcgtgtaacttacgttccggcgggtaacgggtccgtgggaaccgtacggtaacccggttccgttaaccgtccgtacggaccccgtaaaccggg

SEQ ID NO: 376124 - DNA, 604 bp, Homo sapiens
  misc_feature: GZ8MTXP02FKG17.10.72.G06.1.454.CMB.2.raw
  modified_base (470)..(470): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacacccacggccaggcccccagactcatcatttctgatgtcagtgatcggccctttgggactttctaatcgcttctcctcgtcctccaagttctacggccaacaccgggtcctttccccgtagaacccctagtccgtcccgggtcctacccgaccgcttacggacgggacgacggtccttacaagtttacttacgtggtaccngtcctacagtaactacccaccggaggggtaccaactccgttacgtacgtacgttacgtacgggtccggggaaacgggtcccgtacgggcttacggacccgttacccgtaccgtacgaccggacccgtaaccggg

SEQ ID NO: 376125 - DNA, 576 bp, Homo sapiens
  misc_feature: GZ8MTXP02FOLYD.10.72.G06.1.454.CMB.2.raw
  modified_base (360)..(360): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgacttataactatgtctcctggtaccaacaacaccagccacggccccagactcatctatttctgatgtcagtgatcggtcctttggactttctatcgtcttctctcgcctacaagtcncggacaacgaccggtccttccctcgaccctatccgtccgggctccacgtcgtggacggacgaggtctacgtatttactactcgacagtctactaatactaaccgaccgtacggggacctacgttcgttcgtagtacgttacggttcgggacggggtacgggtaccgtcggtccgtacggtaccgttaccgtacgtaccgacgacccgtaaaccggg

SEQ ID NO: 376126 - DNA, 632 bp, Homo sapiens
  misc_feature: GZ8MTXP02HDCVQ.10.72.G06.1.454.CMB.2.raw
  modified_base (228)..(228): a, c, t, g, unknown or other
  modified_base (313)..(313): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccngcagtgacataggtgacttataactatgtctctgtaccaacacacccacgccacggccccagactcatctattctgatgtcagtnagtcggtccgtttggactttctaatctcttctcgtctcctctaagtcgtcgacctaacgcggtcccttaccctcgaaccctacgtccggtcccgggcctacccgaccggcgtaggacgggacgacggccttacgtagtttacttacgtcgactacgtcctacaacttaacaccgaacccgtagggtacctaccgttacttccggtagttaaacgttcgggtaccggggtacgggtaaaccgggtccgttcggggaaccgttaccgggtaacccgttacccggtaaccggttccgtaaaccggaccccggtaaacccggg

SEQ ID NO: 376127 - DNA, 614 bp, Homo sapiens
  misc_feature: GZ8MTXP02JY22S.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttataactatgtctcctggtaccaacaccaccagccacggcccccagactcatcatttctgatgtcagtgactccggtcctttggactttctaatcgtctttctctcgtcctcctaaacgtctgacctaaaccgtccgggtccttccccttacgaccctaccgttcccgtacccggggtcccttcccgaccgccgtaggacgggacgacggtctacctagtttaacttcgtacgcacgtctactataacgtaccaccggtacgggcctaacgttccgttacgtagtacgttacgtttccggggaccggtaacggggtccctggggtccgtaccggacccgtaccgtaccgtcgaccggaccgtaaccgg

SEQ ID NO: 376128 - DNA, 674 bp, Homo sapiens
  misc_feature: GZ8MTXP02IEAM9.10.72.G06.1.454.CMB.2.raw
  modified_base (226)..(226): a, c, t, g, unknown or other
  modified_base (232)..(232): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcactgcacngcagtnacagtaggtgtacttaataactatgtcctcgtacgtaaccaaacaaccaccacggaccaccggccccagactcatctattctagatcgtctagtcgacgtcgtccgtttaggtacctttacgtaactcgtcttcttctcgtccctacgtaaacgttccgtacgtaaccacgtaccggtcccttacccgttacgaaccctacgtcccgttcccggggcccttacccgaacggtcgtacgggacgggtaccgaacggtccttaacgttatttaacgttacgtacgaccgtacgtacctacttaacgttaaccgtaacccgtaacccggacggggttaccctaacgttccgtacggttacgtaacgtttacggttccggggacgggtacggtaccgtcggcgttaccgtacccgttaccgtacgtaccaaccggaccctaaccgg

SEQ ID NO: 376129 - DNA, 658 bp, Homo sapiens
  misc_feature: GZ8MTXP02FTE3F.10.72.G06.1.454.CMB.2.raw
  modified_base (216)..(216): a, c, t, g, unknown or other
  modified_base (251)..(251): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtcgtggtctccgtggacagtccgatccacttanctcctgcacgtggccaccagcagtgacagtaggtnacttaataactatgtctcctggtaccaacacacccagccacgccccagctcatgtatttgatgtactagtaacgtccggcctgtacgggttctaacgtccgtacttctcgtgtacctactagtctcggactaaccgaccgtccctcctacgactagtcctcgtcgacctaccgaggcgtagacggtacgacggtctaggtaaactttacgttacgtcgtactacggtactaccgtaattaaccgtaaccggaaaccctagacccgtaacggtaaccttactttaccggtagttaccggttaccggggaacggggtaacggaacccgtaaagttcccggtaacggtaaccccgttaacccgttaacggggttcccgaaaccggtttacccgaaaccggggttcccccg

SEQ ID NO: 376130 - DNA, 586 bp, Homo sapiens
  misc_feature: GZ8MTXP02HP0FM.10.72.G06.1.454.CMB.2.raw
  modified_base (306)..(306): a, c, t, g, unknown or other
  modified_base (368)..(368): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaatttgtctcttggtaccaacagagcccagacaaacgcccccaaaattatctatttcngctgtcagtaatcggccctgtaggggtttctagtcgcttctcgtcggctcagtctggcaacnccggcctccctgaccctatcctcgtgggccctccgaggctaggaggacgaggctgatttattattgatagctactataactaccaaaacacccgtaaaagtccgtttagacttacgtttacgggcgggaacgggtaacccaaaacgttcgacccgttcgtttacgccgtacgacccgaagccgtccgcccccgttcggtcacctcgttaccttccccc

SEQ ID NO: 376131 - DNA, 572 bp, Homo sapiens
  misc_feature: GZ8MTXP02IUOBC.10.72.G06.1.454.CMB.2.raw
  modified_base (348)..(348): a, c, t, g, unknown or other
  modified_base (364)..(364): a, c, t, g, unknown or other
  modified_base (372)..(372): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttaataactatgtctctgtaccaacaacacccagccacgccccagactcatcatttctgatgtcagtgactccggtcctttggtactttctaatcgtcttctctcncctcaagtctgcaacncgtctccngacctatccgtccggctccacgtcgtgacggacgacggtcctacgtatttacttacgtcgcacgctactaatactaaccgaccggagggcaacgttcgtcgtagtacgtttacggtacggggtaccgggtaacgggtcctacgggtaaccgttccggtacccgttaccgtaaccggtaccgaaccgtacccgtaaaccgg

SEQ ID NO: 376132 - DNA, 624 bp, Homo sapiens
  misc_feature: GZ8MTXP02ISVBJ.10.72.G06.1.454.CMB.2.raw
  modified_base (205)..(205): a, c, t, g, unknown or other
  modified_base (285)..(285): a, c, t, g, unknown or other
  modified_base (295)..(295): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcatcactntctcctgcacgtgcaccagcagtgacagtaggtgcttataactatgtctctgtaccaacaacaccagccacgccccagcncatcatttcngatgtcagtgacgtccggtccctttgggtactttacgtaatcgtcttctctcgtccctctaaagtcctcgaccaaacgcggtccttaccctgaccctacgtccgtccgggcctcccgacgtctacgggaacggaccgtacggtccttataaacgtttactttacgaggtaccacggtcctacgtaacttaaccgtaaccgtaccccggaggggtaccctaaacgtttcgtaccggttgtaacgttaacggttccgggacgggtaccgggtaacgtcgggtccgtacggtacccgtaccgttaccgtaccgaccgtaccccgtaaccggg

SEQ ID NO: 376133 - DNA, 584 bp, Homo sapiens
  misc_feature: GZ8MTXP02HUETB.10.72.G06.1.454.CMB.2.raw
  modified_base (246)..(246): a, c, t, g, unknown or other
  modified_base (383)..(383): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctccgtggacagtcgatcactatctcctgcactggccaccagcagtgacataggtncttataactatgtctctggtaccaacaacacccaggccacggcccccacgactccatcaatttctgatgtcagtgattccggcctttgggactttctaatcgcttctcctgcctcaatctcgcaacacggtcctccnaccactctccggctccacgtctgacggacgaggctcatttacttactgactagctacactaataccacccgacggggactaccgtctacggtgtacgttacggtttaccgggaccggggaacgggtaacccgtgggtaaccgttaccgggtacccggttaccccgtacggttacccgacggtacccccggtaaacccgggg

SEQ ID NO: 376134 - DNA, 538 bp, Homo sapiens
  misc_feature: GZ8MTXP02HKXM5.10.72.G06.1.454.CMB.2.raw
  modified_base (382)..(382): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgccatggcaccagcagtgacataggtgcttataactatgtctcctggtaccaacaacacccaggccacgccccagactcatcattctgatgtcagtgactcggtccctttgggactttactaatcgtcttctcttcgcctccaagtctgaccacgacgtccttcccngaccactccgtccgggctcccgacgtcgtacgaggacgacgtctacgtatttacttacgtgcaagtctacactactaccaccgaggggctacgtctcgtagtactacggttcggcggacggtcctcggctcgaccgtctaacggtcaacgccacgg

SEQ ID NO: 376135 - DNA, 626 bp, Homo sapiens
  misc_feature: GZ8MTXP02GLULF.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacaccaggccacggccccagactcatcatttctgatgtcagtgactcggtcctttggtactttcgtaatcgtcttctctcgtcctaccaagtcttacggaccaacgaccggtccttaccctcggaaccctacgtccgtcccgggtcttaccccgaccgtcgtacggaacggacgtacggtccttactaacttttaactttacgcggtacaacgtccttaacaacttaacggtaaacccacccggaacggggtcctaaccgttacgtcggtaagttactaacggtttccgggacgggaacgggtcctacggtcgtacgtacccgtaccgttaccgtcgaaccggaccctaaaccggg

SEQ ID NO: 376136 - DNA, 675 bp, Homo sapiens
  misc_feature: GZ8MTXP02GMB79.10.72.G06.1.454.CMB.2.raw
  modified_base (484)..(484): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctggtaccaacaacacccaggccacggcccccagactcatctatttctgatgtcagtgatccggcctttgggatttactaatcgctttctcttcgtccctcgaaacgttcgtacggacctaacgaccggtccctttaccccgtagacccctacgttcccgttcccgggccttcccgaacggtccgttcgggaagggaccgaacgggtccttacttaatttactttaccngtaccgaagtcctacaataaccgtaacccgaacccggtacggggacctaaccgttaccgttcggttacggtaaacgtttaccggtttaccgggggaccgggggtaacgggtaccccgttggggtaacccgttaccggtaacccccggttccgttaaacccggtccaaccgggtacccccgtaaacccgggg

SEQ ID NO: 376137 - DNA, 796 bp, Homo sapiens
  misc_feature: GZ8MTXP02FNGEB.10.72.G06.1.454.CMB.2.raw
  modified_base (303)..(303): a, c, t, g, unknown or other
tcagcatagtagtgcacgaccggtgctcgatttagctacgactgcaagggaaagggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccagccaggccccagctcatcatttcngatgtcaggtgtagttggtccctttgggtactttactaaatcgtactttcgtccttgccctaccgtaagttccgttacgggcctaaaaccgacccggggttccctttacccccgtacggtaaacccctaacgttccccgttaccccgggggtaccctttacccccgaacggtcccgttacggggaaacggggtaaacccgggaacggggtacccttacccgtaaagtttttacctttaaaccgttcgaccgtaaacggttccttaaccgtaaacttaaacgttaaacccaaaacccgtaacggaccctaacggtacccttaaaacctttccgtttaaacgggtttaaccggtttaccgggggaacccgggggttaaaacgggggaacccccggttaaaaacgggccccgtttaaccgggggtaacccccggtttacccggttaaaccgggggttaccccgaaacgggtttacccccgggtaaaaccccggggg

SEQ ID NO: 376138 - DNA, 602 bp, Homo sapiens
  misc_feature: GZ8MTXP02GXEMF.10.72.G06.1.454.CMB.2.raw
  modified_base (303)..(303): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactggcaccagcagtgacataggtgcttaataactatgtctcctggtaccaacaacacccagccacggccccagactcatcatttcngatgtcagtgatcggtcctttggactttctatcgtcttctcctcgcctcctaatctcgaccaacgaccggtccttccctcgaccctactccgtcccgggacttcccgaccgcgttacggacggtaccgacgggccttacgaactttacttaccgtggtaccacgtcctacacttactaacccgacccgacggggccaaccgttccgtcgtacgtaagttacggttaccggcgggtacgggaccttcgggtccgtacggtaaccccgttccgtacgtaccgtaccggacccgtaaccggg

SEQ ID NO: 376139 - DNA, 510 bp, Homo sapiens
  misc_feature: GZ8MTXP02FH6PY.10.72.G06.1.454.CMB.2.raw
  modified_base (421)..(421): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaaagtctgcaacaggcttccctgaccatctccgggctccacgctgagacgaggctcattatactgcanctcatatacaccgacgggacgactctcgtgtactagttacggacggacggacgtcgcgtcgtaccgtacctacgtacgacgaccgaacg

SEQ ID NO: 376140 - DNA, 635 bp, Homo sapiens
  misc_feature: GZ8MTXP02H7Y4R.10.72.G06.1.454.CMB.2.raw
tcagcatagtagtgcacgaccggtgctcgatttagctacgactgcaaggggaaaggggggggtctcaggaggcagcgctctcgggacgtctccaccatggcctgggctctgctattcctcacccctcctcactcagggcacagggtcctgggcccagtctgccctgactcagcctgactccgtgtctgggtctcctggacagtcgatcactatctctgcactggcaccagcagtgacataggtgtctaataactatcgtctcctacggtaaccaacaaccaccgacggccaccggccccacgacctcactctattctgtatgtctagtgtacgtccggtccgtttggtacttctaatcgtcttctctcgtcctactaagtcctacgaccaacgtaccgtccttcccgtcgacctacgtcccgtcccgggcctacccgtacgcgtggacggcggacggtactactacgtttacttacgtcgacctacgtctactaacttaaccaacccgtaacccggtaccggggtaccaaccgttcgtaccggttatacgttacggtccggggtacgggtaccgggtaccgtcggggtccgtaccgacccggttaccgtaccgtaccgaccgtacccgaacccgg

SEQ ID NO: 376141 - DNA, 648 bp, Homo sapiens
  misc_feature: GZ8MTXP02GRH0I.10.72.G06.1.454.CMB.2.raw
  modified_base (508)..(508): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgcttataactatgtctccgtgtaccaacaaccacccaggccacgccccagacctcatctatttctgtatgtactagtcgtacgttccggtcccgttttagggtacctttacgtaacttccgtctttacctcttcgtccctacctaaagttccgttacgacctaaccgtaccggtccctttaccccgagtaacccctacgttcccgtcccgggccttacccgaccgtcgtacggacggaccgacggtcttactagtttaacttcgtacncgacgtactacaacttacctaaaccgacccggacggggacctaccgttactaccggttataacgttacgttacggggaccggtacgggaccgttggccgtacggtacccgttctaccggtaccacggtacccgaaccggg

SEQ ID NO: 376142 - DNA, 524 bp, Homo sapiens
  misc_feature: GZ8MTXP02I9USD.10.72.G06.1.454.CMB.2.raw
  modified_base (371)..(371): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcctttggatttctaatcgcttctctgcctcaagtctagcaacacgcttcccngccatctccgggctccacgctcgagacgaggctactattattactgctagcttcatactacaccgagggcctacgtctacgtgacttacgttacgggcggtaacgggccgtcgggctcggaccgttccgtaccgtacgacgacccgtaacggg

SEQ ID NO: 376143 - DNA, 688 bp, Homo sapiens
  misc_feature: GZ8MTXP02ID5XA.10.72.G06.1.454.CMB.2.raw
  modified_base (310)..(310): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagttaggtgacttataactatgtctctaggtaccaacaaccaccaggccacggcccccagactcatctatttcngatgtctagtgacgtccggtccgtttggtactttactaatcgtcttcttcctcgtcccttaccgtaaacgttccgttacggggaccctaaaaccgtccgggttccctttacccccgttcggaaacccctacgttcccggttaccccgggggccctttccccgaaccggttccgtacggggaaccggggaccgggtaacgggtccctttacgttaaacgttttaaacttttacggtacccgtaccgtacgtaccttactaactaccgtaaccgtaccggacgggtacctaccgttcgtacggtagtacgttacggtcgggacggacggtcgtcggtaaccgtccgtaccgttaccgtaccggtccgaccgtaccgacgg

SEQ ID NO: 376144 - DNA, 675 bp, Homo sapiens
  misc_feature: GZ8MTXP02IDGTP.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcacccctcctcactcagggcacgagggtcctgggcccagtctgccctgactcagcctgactccgtgtcgtggtctccgtggacagtcgatcactatctcctgcactggcaccagcaggtgacagtaggtgtacttataaactatgtctcctagtaccaacaaccaccagccacggccccagactcattcctatttctagtatcgtacagtgtacgtcggtcccgtttaggtactttactaagtcgtcttcttcgtcggtccctaccgtaagtccgtacggtaccaacgtacggtcccttccctagaccctacgtccgtcccgggtcctacccgacgtcgacggacgggacgtaacggtcctacgttaacgttaacgtttacgtacgctaacgtcctactaacttaacgtaaacccgtaccggacggggaccttaaccctcgtaccgtagtaaacttccggttaccgggaccggggtaaaccgggtccgtacgggtaaccgtaaccggtacccggttacccgtacggttaccgaccggttaaccccgtaaccccgggg

SEQ ID NO: 376145 - DNA, 639 bp, Homo sapiens
  misc_feature: GZ8MTXP02IA02F.10.72.G06.1.454.CMB.2.raw
  modified_base (312)..(312): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcactggcaccagcagtgacataggtgcttataactatgtctcctggtaccaacaacacccaggccacggccccagctcatcattctgatgtcagtnacgtccggtccgtttggactttcaactcgtcttctcttcgccctaccaacgttcgtacggacaacgtaccggtccttcccgtcgaaccctacgttccgtcccggggtcccttccgaccgtcgtacggacgggtacgacggtctacgtaatttacttacgcgtacacgtcctactactactaaccgacccggacggggtcctaacgttccgtacggttacgtacggttaaaccggttcggggacggggtaacggggtccggttcggtcccgttacggtaaccccggttcccggtaaccgttcccggtaacggtaccccggtaaaccgg

SEQ ID NO: 376146 - DNA, 552 bp, Homo sapiens
  misc_feature: GZ8MTXP02F7644.10.72.G06.1.454.CMB.2.raw
  modified_base (388)..(388): a, c, t, g, unknown or other
  modified_base (490)..(490): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacaggtcatcactatctctgcactggcaccagcagtgactagtaggtcgacttaataactatgtctcctagtaccaacaaccacccgaggccacggccccagactcatgtatttgatgtcatacgtccgcgtagtaggttactacgtcgtctctcgtgcttacgagtctacggacaacgccgtccgtaccncgaactctcgtcgtacgggctaccgagcgtaggacggtacgagtcgtagtaacgtttactcgtcgactagctaacctattacaacgaaactgacagctactntgtaacgtcggacgtacgacacgtctaaccggaactcgtacggtaccacgaccgacgtcccg

SEQ ID NO: 376147 - DNA, 744 bp, Homo sapiens
  misc_feature: GZ8MTXP02IEVXZ.10.72.G06.1.454.CMB.2.raw
  modified_base (281)..(281): a, c, t, g, unknown or other
  modified_base (299)..(299): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtcctcctggacagtcgatcactatctcctgcacgtggccaccagcagtgacagtaggtgtcttaatactatgtctctcgtaccaacacacccngccaccggccccagactnactctatttctgtatcgtacagtgtacgtccggtcccgtttaggtactttccgtaatcgtctttctccgttcgcccttcctaagttccgtcggaccctaacgtaccgggtccttaccccgtagtacccctacgtcccggtacccggtccctacccgaccgtccgttacgggaacgggtaccggacggtaccttaccttaaagtttactttaccgtgacccgtacgtaccttactaacgtaaccgttaaccccgaacccggtaaccgggggtaccaacccgtttccggttaccgggttaggttaaacgtttacggggttacccggggtaccgggggtaaacggggttcccccgggttggggaaccccgtttacccgggggtaaaccccgtttacccgggtaaaccccggtcccggtaaccgggtaaccccccggtaaacccggggg

SEQ ID NO: 376148 - DNA, 513 bp, Homo sapiens
  misc_feature: GZ8MTXP02FJZE0.10.72.G06.1.454.CMB.2.raw
  modified_base (420)..(420): a, c, t, g, unknown or other
  modified_base (484)..(484): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccccttttggggctttctaatcgtcttctcctgcctccaaagtctgcaacacggcttccctgacccatcctccgggctccacgctaggacgacgaggcctnattatactgcagctcatatcacccgagggcactctgtagatacttcggacggtacggctcggcncggtaccgtcctacgtccagccccaacgg

SEQ ID NO: 376149 - DNA, 657 bp, Homo sapiens
  misc_feature: GZ8MTXP02I19PB.10.72.G06.1.454.CMB.2.raw
  modified_base (245)..(245): a, c, t, g, unknown or other
  modified_base (306)..(306): a, c, t, g, unknown or other
  modified_base (312)..(312): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcacccctcctcactcagggcacagggtcctgggcccagtctgccctgactcagcctgactccgtgtcgtggtctcctggacagtcgatcactatctcctgcacgtggcaccagcagtgacagttggncttaataactatgtctctgtaccaaacacaccagccaccggccccagactcatctattctnatgtcngtctactccggtccttggtacctttctactcgtcttctctcgtcccttaccaagttcgtacgtaccaaccgtaccggtccttaccctcgaaccctacgtccgtacccgggtccttccgaccgtcgtacggtaacgggaccgacgggtaccttaccgttaaagtttaaacgtttcgtaaccgtaccgtacgtaccgttaactaaacgttaaccgtaacccgaaccgggtaccggtacctacgttcggtacgttacggtaacgttaccgggacgggtacgggtaccggtacgtacggtaaccgttacgtaacccgtacggtaccgtacccgaccgtacccgtaacgg

SEQ ID NO: 376150 - DNA, 579 bp, Homo sapiens
  misc_feature: GZ8MTXP02F9MJY.10.72.G06.1.454.CMB.2.raw
  modified_base (238)..(238): a, c, t, g, unknown or other
  modified_base (362)..(362): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctctcactcagggcacagggtcctgggcccagtctgccctgactcagcctgactccgtgtctggtctcctggacagtcatcactatctcctgcactggcaccagcagtgacagtaggtncttataactatgtctctgtaccaacaacacccgagccacggccccagactcatctatttctagatgtcagtgactccgtccgtttggtactttcatcgtcttctctgcctcaagtctcgacacncgtcttacccgtgaccctacgtccgtcccgggcctacccgacgtcgtacgaacggacgagtcctactatttacgtactcgactacgcctacacttacgaaccacccggagggactaacctccgtacgtagtacgttacgggtcggaccggggttacggaaccgttcggccgttacggtacccgtaccgttaccgaccggaccgacccgttaaccggg

SEQ ID NO: 376151 - DNA, 709 bp, Homo sapiens
  misc_feature: GZ8MTXP02G9CC7.10.72.G06.1.454.CMB.2.raw
  modified_base (249)..(249): a, c, t, g, unknown or other
  modified_base (464)..(464): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcacccctcctcactcagggcacagggtcctgggcccagtctgccctgactcagcctgactccgtgtcgtggtctcctggacagtcgatcactatctcctgccacgtggacaccagcagtgacagtaggtntacttaataactatgtcctaccgtacggtaacccaacaacccacccgacggcccaccggaccccctagctcattcgtattttgatgtactagtacgtccgccttaggtaggggtttactacgtcgtctttcgtcgtcggtaccttaccgagttcgtacgggaccaaaccggcccggtccctcctacggtaccctacttcccgtcgtcggggtccncccggtaagtccgtaggacgggttaacgacggtcgttaggtacgtttaaacctgggtacaccgtaacgtccctaagtaacttaaacctaaccgaaacccggtaacgaaccgtacgtacctttaccgttacgttacggttaccgggtacggggaaccgggtaaccgtaaccgacggttacccgtaaccggtacccggttacccggtaacggtacccggaaccgtaaccccgggtacgtacccccgg

SEQ ID NO: 376152 - DNA, 631 bp, Homo sapiens
  misc_feature: GZ8MTXP02IQXR6.10.72.G06.1.454.CMB.2.raw
  modified_base (354)..(354): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcacagcagtgacagtaggtgacttataacttatgtctcctggtaccaacaaccaccaggccacggccccagactcatctatttctagatgtcagtgactcggtccctttggtactttctaatcgtcttctctcncctcaacgtctagccaacgaccgtcttccctgaccctatccgtccggccctaccgacgtcgtacgacgggaccgaggtcctacgttaattacgtttactgacctcgtacctacaacttactaacccgacccggaacggggtccaaccgtttcgtaccggttacgtaaacgttaccggtttaccggggcggggaaaccgggttcccgttacggtaacccgttacggtaccccgtttaccggtaccgttacccgaaccggtaccccgtaaaccccgggg

SEQ ID NO: 376153 - DNA, 681 bp, Homo sapiens
  misc_feature: GZ8MTXP02H47CR.10.72.G06.1.454.CMB.2.raw
  modified_base (139)..(139): a, c, t, g, unknown or other
  modified_base (241)..(241): a, c, t, g, unknown or other
  modified_base (252)..(252): a, c, t, g, unknown or other
  modified_base (611)..(611): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacngggtcctgggcccagtctgccctgactcagcctgactccgtgtcgtggtcctccgtggactagtcgatcacttatctcctgctactggccaccgagctagtnaacagttaggngtacttaataaactagttcgtccttaccgtacggtaacccaaacaaccaaccccgaggaccccaaccggaccccccagaccttacctagttacgtttaatttttgaattacgttacgtaaacgttaccgtcccggtaccccgtttaggttaacggggtttacttaaccgttccccgttacgtttcctccggtttcggacccttacccgtagtccgttacgaccctaaaccgccccggtaccctccctaccgaaccttctcgtccgggtcgtaccctccgaggtccgtaggaagggtacgacgtccgttaagtacttttaacgtacgtgacgacgtctactaactactaaccgacacgtnacgtcctatcgttagtcgcggacggacgactacgcgtaacgacccgtgtaccgcgaccgccgaggtcccc

SEQ ID NO: 376154 - DNA, 668 bp, Homo sapiens
  misc_feature: GZ8MTXP02G1AAK.10.72.G06.1.454.CMB.2.raw
  modified_base (249)..(249): a, c, t, g, unknown or other
  modified_base (262)..(262): a, c, t, g, unknown or other
  modified_base (306)..(306): a, c, t, g, unknown or other
tcagcatagtagtgcacgaccggtgctcgatttagctacgactgcaagggaaaggggggggtctcaggaggcagcgctctcgggacgtctccaccatggcctgggctctcctattcctcaccctcctcactcagggcacgagggtcctgggcccagtctgccctgactcagcctgactccgtgtctgggtctcctggacagtcgatcactatctcctgcactggacctaccagcagtgactagtagggntacttaataactntgtctcgtgtaaccaacaacaccgaggccacggcccccagaccncatcatttctagatcgtacgagtgtacgtccggtaccgtttagggtactttaccgtaactccgtactttccgtctcgtaccctccgtaaacgtcctacggacctaaccgtacggtcccttacccgtacgacccgtacttcccggtccgggtacctacccgacgtcgtacggaacgggacgtacgtaccttactagtttactacgtcgacgtacgtacctaccgtaagttaaccgtacccgaccggtagggtacccttaacgtccgttacgttacgtacgtttacggttacgggcgggtaaacggccgtacggtcctaaccggtaaccgttcgtacggtaccacggacccgtaacggtccccg

SEQ ID NO: 376155 - DNA, 769 bp, Homo sapiens
  misc_feature: GZ8MTXP02HYZGS.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctggtcctccgtggacagtcgatcactatctcctgcactcggaccaccgagcaaggtgactagttaggtgtacttaataactatcgttcctctacggtaccaaacaaccacccacggccacggcccccagactcactctatttcttagattgtctagtcgtacgttccggtccttttggggtaccttttacgttaacgttccgtccgtttctccgttccgtcccgttacctaaacgttcccgtaccgggtaaccctaaaaccgtccggggttaccccttttaccccgacggttaaacccccctacgttttccccgcccccgggggtacccctttacccggaacccggtccgttaacggggaacggggaccgaaacgggttccttaccgtaaactttttagttaaccgtcggttaccactaccctactaacgtaactacccgtaacccgggaacgggtcctaaccgttaccgttcggttacgtaacgttacgggttaacccggggcgggtaaaccgggtacccgtcggtaacccggttaccggtaaaccccggttcccgaacggtaccgaacgaccccggtaacccgg

SEQ ID NO: 376156 - DNA, 714 bp, Homo sapiens
  misc_feature: GZ8MTXP02I0WZV.10.72.G06.1.454.CMB.2.raw
  modified_base (240)..(240): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtncttatactatgtctctgtaccaacaacacccagccacgccccagactcatcatttctgatgtcagtcgtagtccggtccttttgggactttcctaattccggtactttctccgtcgtccccgttacctaaacgttccgttacgggacccaaaacgtaccggggttccctttaccccctaggtaacccctaacgttcccggttaccccgggtcccttacccgaccgtaccgttacggggtaaaccgggaaccggtacgggtacctttaccgtaaatttttaaaccggtttaaccttacgggccgtaaacgtcccgttaactacgttaaaccttaaccggaccccggttaaacgggggcctaaccttcgtaaccgttgaaccgtttaagttccgggggaccgggtaacgggcccgtttacggaacgttaccggtaaacccggtttcccgtacggttaccgaccggacccgtaacgg

SEQ ID NO: 376157 - DNA, 659 bp, Homo sapiens
  misc_feature: GZ8MTXP02HGL87.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctggtctccgtggacagtcgatcactatctcctgcactggcaccagcagtgacagtaggtgtacttaataactatgtctctagtaaccaacaaccaccacgccaccggaccccagactcatgttattttgatgtactaagtactccggtcctacggtacgggtttctaacgtcgtccttcgtctcggccttaccgtagtcgtacgaccaaaccgccgtccctacccgtacgaaccctacgttcccgttccgtcggggtccctaccggtacggtaccgtacgggaacgggtacggaacggtccttaggtaaattttaacgtacttacggactacgtactaacaacttaaactaaaccgaaaccacgtacaacgtacccttacttacgtacgttaccggtacggggacgggaaccggtaaccgacgtacgtaaccgtaccgttacgtaacggtaccgaccggtaccggaacgtccccg

SEQ ID NO: 376158 - DNA, 562 bp, Homo sapiens
  misc_feature: GZ8MTXP02HAO7F.10.72.G06.1.454.CMB.2.raw
  modified_base (200)..(200): a, c, t, g, unknown or other
  modified_base (210)..(210): a, c, t, g, unknown or other
  modified_base (243)..(243): a, c, t, g, unknown or other
  modified_base (300)..(300): a, c, t, g, unknown or other
  modified_base (423)..(423): a, c, t, g, unknown or other
  modified_base (447)..(447): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgacctccgtgtcgtggtctccgtggacngtcatcactntctctgcactggcaccagcagtgacagtaggtntacttaataactatgtcctctggtaaccaaacaacacccagccacggccccagactnactgtatttgatgtctagtacgtccgcctgtaggttctaacgtcgtcttctcgtgcctacagtctgacaccgacgtccctcctacgacctatcctcgcggcctcgacggctggacggagcgtntagtattatacgtgactgtactanaacttacgaacaacgaggacacgtacttacttccgtaaagttcgtacggacgggtaacgggtaaccacggtcgtaacgtcccgtacgttacggaccgtacggaccgtacgccccg

SEQ ID NO: 376159 - DNA, 738 bp, Homo sapiens
  misc_feature: GZ8MTXP02I7QMC.10.72.G06.1.454.CMB.2.raw
  modified_base (210)..(210): a, c, t, g, unknown or other
  modified_base (216)..(216): a, c, t, g, unknown or other
  modified_base (234)..(234): a, c, t, g, unknown or other
tcagcatagtagtgcacgaccggtgctcgatttagctacgactgcaaggggaaagggggggtctcaggaggcagcgctctcgggacgtctccaccatggcctgggctctgctattcctcaccctctcactcagggcacgagggtcctgggcccagtctgccctgactcagcctgactccgtgtcgtggtcctcgtggacagtcatcactntctccngcagtgccacagcaggtnacagtaggtcgtcttaatactatgtctccgtagtaccaacaacaccgacgccaccggcccctagactcatcgttagtttcgattgtacgtagttaacgtcccggtacccgttaggtacggggtttacctaaccgttccgtccgtttccgtcgttcggtcccgttaaccgtacggttccgtacggggtacctaaacccggtacccgggtccccttacccgtacggtaaacccctactttcccgtccggtccggggtaaccttcccgggaaacggtcccggttagggaacggggtaccggtacgggtaccttaaggttactttaaaccgttcgttagacctacggtacttaaacctattaaccgaaacccggtaaacctagaccggaacgttacctaccgttacgttaaacggttcggttaccggggaacgggaaccggtaaacgtccggtacgtaaccgggtacccgtacgtacgggtaccaccggaccgtaacggttcccccgg

SEQ ID NO: 376160 - DNA, 653 bp, Homo sapiens
  misc_feature: GZ8MTXP02GEMQI.10.72.G06.1.454.CMB.2.raw
  modified_base (195)..(195): a, c, t, g, unknown or other
  modified_base (241)..(241): a, c, t, g, unknown or other
  modified_base (304)..(304): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctggtctcctggacngtcgatcactatctcctgcacgtggcaccagcagtgacagtaggtncttatactatgtctctagtaccaacaaccaccgacggccacggccccagctcactctatttcngtatgtcgagttgtacgtccggtaccgtttgggtacttttacctaagtccgtctttcctcttcgtccctaccgtaacgttccgtacggacctaacgtaccgtccctttacccgtacgtaccccgtacgttcccggttcccgggaccttacccgaccgtcggtacggacggtaaccgtaggtaccctacttaacgtttacttaccgttacgccgaacgttcccgttacaacttaacgtaacccgacccgggtagggtcccttaaccgtcgttaccgtagtacgttaacgtcgggacggtacggccgtcgtcgtaccgtacccgtcctacggtaccaccgaccgtacccgg

SEQ ID NO: 376161 - DNA, 621 bp, Homo sapiens
  misc_feature: GZ8MTXP02FN3QB.10.72.G06.1.454.CMB.2.raw
  modified_base (233)..(233): a, c, t, g, unknown or other
  modified_base (243)..(243): a, c, t, g, unknown or other
  modified_base (310)..(310): a, c, t, g, unknown or other
  modified_base (450)..(450): a, c, t, g, unknown or other
  modified_base (457)..(457): a, c, t, g, unknown or other
  modified_base (464)..(464): a, c, t, g, unknown or other
tcagcatagtagtgcacgaccggtgctcgatttagctacgactgcaaggggaaagggggtctcaggaggcagcgctctcgggacgtctccaccatggcctgggctctgctattcctcacccctcctcactcagggcacagggtcctgggcccagtctgccctgactcagcctgactccgtgtctgggtctcctggacagtcgatcactatctcctgcactggcaccagcagtnacatagggtncttaataactatgtctctaggtaccaacaaccaccgacggccacggcccccagacctcatctattcngtatgtacaggtgtacgtccggtccgtttggtactttactaacttccgtcttctccgtcgtccctaccgaacgtccgtacggaccaaaccgtccgggtcccttcccgtgaaccctacgtccgtccgggcctcccgaccgngtacggnggaacgngtacctactattacgttacgtcgacgtaactcctaatactaaccgtaccgaacccggtagggccctactcgtacggtatacgttaacgggtcgggaccgggtacgggccgtagggccgtaccggtacccgtacgtccgtacaccggacccgtaacgg

SEQ ID NO: 376162 - DNA, 671 bp, Homo sapiens
  misc_feature: GZ8MTXP02F7PLN.10.72.G06.1.454.CMB.2.raw
  modified_base (204)..(204): a, c, t, g, unknown or other
  modified_base (449)..(449): a, c, t, g, unknown or other
  modified_base (470)..(470): a, c, t, g, unknown or other
  modified_base (485)..(485): a, c, t, g, unknown or other
  modified_base (510)..(510): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacgagggtcctgggcccagtctgccctgactcagcctgacctccgtgtcgtgggtctccgtggacngtcgatcactatcctcctgcacgtggacaccgagcagtgaactagttaggtgtacttaagtaactatcgttcctccttacggtaacccaaaccaaccaaccccgacggacccgaaccggacccccagacctctactcgtactttccgtgtaatcgtacaggttcgtacgtccggtaccccgttttgggtaacctttacgtaactcgtcttctctcgcctacagtctcgaactacgacgtccttcncgacctctaccgcggctacgnggtctaggacgacgngtcgtataagtttatacgtcgacgntaccctataacttaaccaaaccgaccgaaacgcctaaacggtaccctttacgtttacgttacgttaccgggttaccggggaccggtaaacgggaccctaaacggtaacccgtaccggtaccgttaccggtacggtaccaacccggtacgtaacccccgggg

SEQ ID NO: 376163 - DNA, 617 bp, Homo sapiens
  misc_feature: GZ8MTXP02HKGCZ.10.72.G06.1.454.CMB.2.raw
  modified_base (568)..(568): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatcctctgcactggcaccagcagtgactagtaggtgacttataactatgtcttacctggtaaccaacaaccacccgacggcccaccggcccccagacctcactctatttctagtatgtctagtgtacgtcggtcccgtttaggtactttacgtacgtcgtctttcctcttcgtccctcgtaacgtccgttacgaccaaccgtaccggttcccttcccgtaccgaccctactccgtcccggtcctcccgacgtcgtaggacgacgacgcctctatttacttacgtcgacgactctactacgtaacaccgaccgaggctacgttcgtacgtgaacgttggtaccggacggggaacgtccgnggtaaccgtacggtacccgtaccgtacgtccgaaccggtacccgaccgg

SEQ ID NO: 376164 - DNA, 665 bp, Homo sapiens
  misc_feature: GZ8MTXP02I7N4O.10.72.G06.1.454.CMB.2.raw
  modified_base (199)..(199): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacngtcgatcactatctcctgcactggcaccagcagtgacagtaggtgtcttaataactatgtctctcggtacaacaacacccaggccacggcccccagactcatctatttctgatgtcagtcgtacgtccggtccgtttaggtactttactaacgtcgtactttctccttcgtccctaccgtaaacgttcgtacggacctaaaccgtacccgggtccttaccccgtagtaccctacgttcccggtcccgggtccctttcccgaaccggtccgttacgggaacggtaccggtacgggtaccttaccgtaaagtttacttaacgtcggtactaacgtacctacgtaacttaccgtaaaccgtacccggaaggggacctacgttaccgtcggttagtacgttacggtcggggtacgtaacggtcgtcggtcgtccgtaccgtccgttacgaccgtaccgaccgtaaccggg

SEQ ID NO: 376165 - DNA, 563 bp, Homo sapiens
  misc_feature: GZ8MTXP02JKWX7.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggccccagactcatcattctgatgtcagtgatcggtccctttgggacttttcgtaatcgctttctctacgcctccaagtctggcctaacgaccggtccttccctgacctactcgtcccggcctccacgctggacggtacgaggtctcgtaattattacctgacagtctacactacgtaacacccgagggtcaccttcgtagtacgacgttaacgttcggacgggtaacgggccctggccgtacggtcccggtaccgttaacgccgaaccgacccgtaaccgg

SEQ ID NO: 376166 - DNA, 667 bp, Homo sapiens
  misc_feature: GZ8MTXP02JN9PB.10.72.G06.1.454.CMB.2.raw
  modified_base (245)..(245): a, c, t, g, unknown or other
  modified_base (513)..(513): a, c, t, g, unknown or other
  modified_base (527)..(527): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctccgtggacagtcgatcactatctcctgcactggccaccgagcagtgactagtaggtntcttaataactatgtcctccgtaggtaaccaacaaccaccccgaggccaccggccccagacctcatctaatttctagatgtacagtcgacgttccggtaccgttttggacctttctaatcgtccttactctcgtccctacgtaacgttcgtacgggacctaacgaccggtcccttacccgtcgtaaaccctcgtcccggtcccggggtccctacccgacggccgttagggacgggaaccggacggtacctacttaattactttaacgngtacgataccctanaacttaccgacccgtaccgggtacgggacctaccgtacgtacgtagtaacggttacggtcggggtacgggacgggtaccgtcggtaaccgttcggtaaccccgttccggtaaccgtccgaaccggtacccgtaacccggg

SEQ ID NO: 376167 - DNA, 702 bp, Homo sapiens
  misc_feature: GZ8MTXP02GZ97K.10.72.G06.1.454.CMB.2.raw
  modified_base (260)..(260): a, c, t, g, unknown or other
  modified_base (329)..(329): a, c, t, g, unknown or other
  modified_base (399)..(399): a, c, t, g, unknown or other
tcagcatagtagtgcacgaccggtgctcgatttagctacgactgcaagggaaagggggtctcaggaggcagcgctctcgggactctccaccatggcctgggctctgctattcctcaccctcctcactcagggcacgagggtcctgggcccagtctgccctgactcagcctgactccgtgtcgtgggtcctccgtggacagtcgaatcacttatcctccgtgccacgtcggccaccgaggcaggtgaacaggtaacgggtnacttataactatcgtcctcgtacgtaaccaaccaacaccgaggccaccggccccagactcatactattntgatcgtgagtcgtacgtccggtccgtttaggtactttacatcgtcttcgtctcgtcctcgtaacgtcgngaaccaacgtacgtcccttacctacgtaaccctacgttcccgccgggtaacccttccggaccggtacgtacgggtaaccgggaccggtaacgtaccggtaacctttagttacggtttaacccgacgggtacctacggtactaccgtaacgtaaccgtaacccggtaccggtacgtacccgttacgttaccgtacggttaacggtaaccggtttaccgggtaccggggtaccgggtaaacgggtccgttacggtaacccggtaaccggtacccggttacgtaccgtaccgaccggtaccgtccg

SEQ ID NO: 376168 - DNA, 632 bp, Homo sapiens
  misc_feature: GZ8MTXP02G4ZZV.10.72.G06.1.454.CMB.2.raw
  modified_base (201)..(201): a, c, t, g, unknown or other
  modified_base (509)..(509): a, c, t, g, unknown or other
  modified_base (518)..(518): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtcgtgggtctcctggacngtcgatcactatctcctgcactggcaccgagctagtcgacagtaggtgtacttaatactatcgtcctccgtcgtaaccaaaccaaccacccgacgaccacccggccccaagactctactctactttctgtatcgtactagtcgtacgttcgtaccgttggtacctttacgtagtcgtcttctcgtctcctacgtagtccgtacgacctacgtccgtaccctttaccgcgtaccctacgtcccgtccggtccctaccgaccggtacgtacgggaacggaccgtacggtccttaactaatttacgttacncgtactacnctaccagtaaccgacgaccggtagtactacgttcgtagtacgtacgtacgggtacggacgtacggtcgtacggtaaccgtccgtacccgtacgtacgaccgaccgtaccgtacg

SEQ ID NO: 376169 - DNA, 764 bp, Homo sapiens
  misc_feature: GZ8MTXP02JYUY8.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggccacagcagtgacataggtgcttaataactatgtcctcctaggtaccaacaaccaccacggccacggacccccagactccatcctatttacctgtaactgtacagtcgtaactccgggtcccgtttggggtaactttcgtaagtccgtcttctccgtcgtccctaccgtaacgttcctacgaccgaaccgtaccggtcccttaccccgtacggaaacccctacgttcccgtccccgggggttaaccccctcccggtaccggtccggtacgggaccgggaccggtacggtaccttaacgttaacgtttacgtacgtacgtaccgtaacgtaccttaacgtaaccttaacccgtaacccggtaacccgggtaccgggttaccctaacccggtttccggttaccggtaacggttaaccggtttaacggggttacccgggggaccggggttaccgggtacccggttcgggtaacccggttacccggttaaccccggttacccggttaacccggtacccggtaacccggtacccccggtaacccgg

SEQ ID NO: 376170 - DNA, 518 bp, Homo sapiens
  misc_feature: GZ8MTXP02F9URP.10.72.G06.1.454.CMB.2.raw
  modified_base (362)..(362): a, c, t, g, unknown or other
  modified_base (371)..(371): a, c, t, g, unknown or other
  modified_base (393)..(393): a, c, t, g, unknown or other
  modified_base (398)..(398): a, c, t, g, unknown or other
  modified_base (420)..(420): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtcctcctggacagtcgatcactatctcctgcactggcaccagcagtgacataggtgcttataactatgtctctggtaccaacaacacccaggccaggcccccagactcatcatttctgatgtcagtgatcggcctttggactttctaatcgcttctctgcctcaagtctgcaacncgtcttccngaccatctccggctcacgctgngacgngactcattattactgcagctanatactacacccgagggcctaactcgtcgtagacttacgttacggcgggaacgggtcctggaacctcggacccgtcctaacgtcacggtacccaaccgg

SEQ ID NO: 376171 - DNA, 671 bp, Homo sapiens
  misc_feature: GZ8MTXP02GFQ8C.10.72.G06.1.454.CMB.2.raw
  modified_base (560)..(560): a, c, t, g, unknown or other
  modified_base (661)..(661): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgacctccgtgtctgggtcctccgtggaccagtcgatcactatcctcctgcactggccaccagcagtgacagtaggtgtacttaataactatcgtcctcctacggtaacccaaaccaaccaccccgacggacccaccggacccccagacctactacttgttacttttgattcgtacgtaacggtacgtcccggtaccttacggtacggtttctaacgtccgtccttcgtcgtcggtcctacgtacgtccgtacggacctaaccgtcccgtccctacccgtacgacctcgtacccgtcgtcgggcctaccgacggcgtgggaacggtaggacgtcgtacgttatttaacgttgtgtacgactcctaacgtactaactaaccgaaaccgngaccgtacgtcccttaacggtttcgtacggttacgggttaccgggaccggaacgggaccacgtccgtaaccgtcccgtacgtacgggtacaccggtaaccncgggtccccg

SEQ ID NO: 376172 - DNA, 707 bp, Homo sapiens
  misc_feature: GZ8MTXP02GX2P5.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcacgtggcaccagcagtgacataggtgtacttataacttatcgttcctacctcggtaaccaaacaaccaccccgaacggcccacggaccccccagtacctcaatcctacgtttcagtacttgtacagtgacgttccggtcccgtttaggtactttacgtactcgtcttctcgtctccctcgtaacgtcgtcgacccaacgtccggtcccttacccgtacgtaaccctacgttccgtcccggggtacctcccgtacgaccggttagaacggtacgggacgtaccgtactaacgtttacttactacgccgtaagtcctactaaacgtaaccttaaccgaccccggtaaggggtccctaacgttacctcggttaccgtaagtttaccggtaccgggggtaccggtaaaccgggtccgttaacgggccgttaccgggtaaacccgttcccggttaaaccgttaccgaaacccgggtaacccgtaaaccccgggg

SEQ ID NO: 376173 - DNA, 609 bp, Homo sapiens
  misc_feature: GZ8MTXP02GSWX3.10.72.G06.1.454.CMB.2.raw
  modified_base (239)..(239): a, c, t, g, unknown or other
  modified_base (249)..(249): a, c, t, g, unknown or other
  modified_base (318)..(318): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctccgtggacagtcgatcacttatcctcctgccactggccaccagcagtnactagtggtntacttaataactatcgtcctctaggtaccaacaacacccgaggccaccggccccagcctcatctattcnatcgacagtcgtacgtccggtccgtttggactttctatcgtcttctctctcctctagtcgcgacaacgtcgtcctaccctgacctacgtcccgtccggtcctccgaccgtcgtacggacgtacgacggtacctacttaacgttacttcgacgtctacgtactactaactaaccgtaccgaccggtacgggtacctacgttacgtcgtacgtacgttaccggtcgggacgggtacgtaccggtcggtaaccgtccggtaccgttccgtacgtccgaccggtaccgtacccgg

SEQ ID NO: 376174 - DNA, 639 bp, Homo sapiens
  misc_feature: GZ8MTXP02I2IJW.10.72.G06.1.454.CMB.2.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctccgtggacagtcgatcactatctcctgcatggcaccagcagtgacagtaggtgacttaataactatgtcctctagtaccaacaacaccaggccacggccccagactcatctaatttcagatcgtcaggtgacttccggtaccgtttgggtaccttttactaagttccgtctttactccgttcgtccctaccgtaaagttccgtacggaccaaaacgtccggtcccttacccgtacgtacctacgtccgtccggcctaccgacgcgtaggacgacgagtactactaagttacttacagcgtatacctataactacgtaaccacccggtagggacctaacgttctacggtacgtaaagtacggttacggggaccgggtaaacgggtcccgtaggtaaccgtaccggtaaccgttacccgttaacgtacccaaccggaacccgtaaacggg

SEQ ID NO: 376175 - DNA, 650 bp, Homo sapiens
  misc_feature: GZ8MTXP02GI12Y.10.72.G06.1.454.CMB.2.raw
  modified_base (231)..(231): a, c, t, g, unknown or other
  modified_base (285)..(285): a, c, t, g, unknown or other
  modified_base (299)..(299): a, c, t, g, unknown or other
  modified_base (305)..(305): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatctcctgcactgcacagcagtnacataggtgcttataactatgtctctgtaccaacaacaccacgccacgccccanactcatcatttctntatgtnagtcgatccggtccgtttggactttcgtaatcgtacttctcgtctcctactacgtcgtcgacaacgtacggtccttccctacgacctacgtccgtcccggccttacccgacgtcgtacggacgggtaccggacggtaccgttacgtactttaacttaacgtgtaccgtactaccgttacaacttaacaacccgaacccggtacgggggtaccctaacgttccgttacgtttacggaaacgtttacggttccgggaccggggtaacggggtacccggtggtcccggttaaccggtacccggttacccgtaaaccgttccggaacccgttaccccggtaaacccggg

SEQ ID NO: 376176 - DNA, 704 bp, Homo sapiens
  misc_feature: GZ8MTXP02J0L5N.10.72.G06.1.454.CMB.2.raw
  modified_base (240)..(240): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcacgtgcacagcagttacagtaggtntacttaataactatgtctcctagtaccaacaaccaccacggccacggccccagactcatctatttcagtatgtctagtgtacgtcgtcccgtttagggtactttacctaactcgtcttcctctccgcctccgaaacgttcgtacggtacaaaccgtaccggtcccttacccgtacgtacccgtacttcccggtacccgggtcccttacccgaccgtaccgttacggaacgggtacccggacgggtacttaccggttaattaactttacgtacggtactacgtacttaccgtaacttaaactaacccgaaccccggtacgggggtaccctaaacgttccgttaccggtagtacgtttacggttaccgggggaccggggtaacgggtacccggtcgggaccgttaacggtaaccccggttccgttacccggttaaccggaccgttaaccccggaacggtcccccgg

SEQ ID NO: 376177 - DNA, 640 bp, Homo sapiens
  misc_feature: GZ8MTXP02JKPRZ.10.72.G06.1.454.CMB.2.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtcctcctggacagtcgatcactatctcctgcactggcaccagcagtgacagtaggtgacttataactatgtctctagtacaacacaccagcacgcccagctcatgtatttgatgtactagtaacgtccggtaccctgtacgggtttactaacgtccgtacgttctcgtcgactaccgtagttcgtacggaccaaaccgtccgtaccccgtccctacgaccctagttccctacggtcggtcccttacgacggtccgtagggaaccgggtacggtacggtcttacggtaactttacgtacgtacggacctacgtactaccctaaagttaccaaaccgtaaccgacgaccgaaacgtccttaaccttcgtacgttacggttccgggaccggtaacgggaccctaggccgtaacgtaccggtaccgtacggtaccaccgtacccgtaacggtccccg

SEQ ID NO: 376178 - DNA, 696 bp, Homo sapiens
  misc_feature: GZ8MTXP02GDA78.10.72.G06.1.454.CMB.2.raw
tcagcatagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctaggtaccaacaacaccgagccacgccccagactcatctatttctgatgtcagtgtacgtccggtccctttgggtactttacgtaactcgtcttctcttcgcctccaacgtctcgacctaacgacgtccttacccgtcgtaccctacgtccgtcccggccctcccgaccggtacgtacgggaacgggaccgacgggtcctaacgttaactttaacgtttaaccgtcggtaccgtaacgttacctaccttaaacgtaacccttaaacccgaaccccggaacgggggtaccctaaccgttccgttaccgttaggtacgtttaaacgggtttcccgggggacggggtaaccggggtaacccgttcggggtaacccgttaaccgggtaccccggtttacccgtaaacccggggttcctaaaacccggccccggttaaacccggg

SEQ ID NO: 376179 - DNA, 854 bp, Homo sapiens
  misc_feature: GZ8MTXP02FF9WP.10.72.G06.1.454.CMB.2.raw
  modified_base (245)..(245): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctctcactcagggcacagggtcctgggcccagtctgccctgactcagcctgactccgtgtctgggtctcctggacagtcgatcactatcctcctgcactggaccaccagccagtgactagtaggtnactttaataactatcgttctaccgttcggaaccaaacaaccacccgacgggacccaccggcccccaagacctactactacttaattttccgtagtaacgttgtaccagggttacgtaaccgttccgggttacccccgttttttaggggtaacctttttaccgttaaacgtccgtccttttaccctccgttaccggttcccctaacccgtaaacggtttccgtcgggaaaccctaaacccggtaacccggggtcccttttaaccccgtacggtaaccccctaacgtttccccggtaacccgggggttccctaaaccccggccggttacgtacgggggacggtaaaccggcggttaccttacccgttaagttttaaccttaaccgcgggttaacccgacgtaccctttaaaccgggaacttttaaaacccggtaccccggaaccccggggaacggggtcccttaaaaccgtcggttaccggtacgttaaaacggttaccggttccgggggacggggtttaaaccggggcccgttacgggtaacccgttaaccggttaacccccggtaccgtttacccggtacccgaaaaccggtcccccggtaaacccggg

SEQ ID NO: 376180 - DNA, 727 bp, Homo sapiens
  misc_feature: GZ8MTXP02GGLYJ.10.72.G06.1.454.CMB.2.raw
  modified_base (224)..(224): a, c, t, g, unknown or other
  modified_base (240)..(240): a, c, t, g, unknown or other
  modified_base (250)..(250): a, c, t, g, unknown or other
tcagcatagtagtgcacgaccggtgctcgatttagctacgactgcaagggaaagggggtctcaggaggcagcgctctcgggactctccaccatggcctgggctctgctattcctcaccctcctcactcagggcacagggtcctgggcccagtctgccctgactcagcctgactccgtgtctgggtctcctggacagtcgatcactatctcctgcactggcaccngcagtgacagtaggtncttataactntgtctcgtgtaccaacaacaccgagccacgccccagctcatctatttcgtagtatcgtacgtaagtcgtacgttccggtcccgttttgggtacctttttaccgtaacttcgtcctttctccgttcggtcccttaccgtaacggttcctacgggtccaaaaccggtccgtccctttacccgacgtaacccctacgtcccggttcccggcccttacccctaccggacgttaaccggggaggaaacccggcggtacccttaacgttacgttttaaactttaccgacgggttcccgaacgttaccgttaaccctaaggtttacctaaaccccgtaacccgggtcggggaaacctacccgttccgttcgggtaatttacggtaacgggtttccgggggacggttaaccgggggacccctttggccggtttacccgaacccgttacccggttcgtaaaccgtccggtaccccgtaacccgggg

SEQ ID NO: 376181 - DNA, 660 bp, Homo sapiens
  misc_feature: GZ8MTXP02FT17G.10.72.G06.1.454.CMB.2.raw
  modified_base (205)..(205): a, c, t, g, unknown or other
  modified_base (216)..(216): a, c, t, g, unknown or other
  modified_base (242)..(242): a, c, t, g, unknown or other
  modified_base (253)..(253): a, c, t, g, unknown or other
  modified_base (611)..(611): a, c, t, g, unknown or other
tcagcatagtagtgcacgaccggtgctcgatttagctacgactgcaaggggaaaggggggggtctcaggaggcagcgctctcgggacgtctccaccatggcctgggctctgctattcctcacccctcctcactcagggcacgagggtcctgggcccagtctgccctgactcagcctgactccgtgtcgtgggtcctccgtggacngtcgatcactntctcctgctactggccaccagcagtnactagtaggtnacttaataactatcgttctccgtaggtaacccaacaaccacccgacggacccaccggcccccaagacctacagttacggtttattttagattagtaccgtaaggttaacgtcccggccctaggtaacggggtttactaaccgttccgtctttcgtcgtacggtcccttaccgtagtcgtacggaacctaacccgacccggttcccctacctacgtaccctacttcccgtcgtcgggctccgaggccgtagacgggtagacgtcttagtattaattcgcgacgtactactactaatacgtaaccaaacgcgaactgtaccttacttcgtacgtcggtaacggacgggacgggtaaaccncggtacgtaaccggtaccgtacgtacgaccgtacgacccggtcgtcccg

SEQ ID NO: 376182 - DNA, 707 bp, Homo sapiens
  misc_feature: GZ8MTXP02H9DGL.10.72.G06.1.454.CMB.2.raw
  modified_base (431)..(431): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcacccctcctcactcagggcacgagggtcctgggcccagtctcgccctgactcagcctgcctccgtgtcgtggtctcctggacagtcgatcactatcctctgcacgtgaccacagctagtgactagtaggtgtacttaatactatcgtacctccgtacgtaacccaacaacccacccgaccggacccacccggaccccacgtacctcactctatttctagtatgtactagtgtacgttccggtccgtttaggtaccctttacgtactcgtacttctcgttcgcctacgtagtcgcgacacgtccgtcctaccncgacctcgtccgacccggtcctaccgacgtacgtacggaacgggtaccgacggtaccttacgttaacgtttacttacgtacgaccgtactccgtaacttaacaacccgtaaccggaacccgggtcggtaccctaccgttacggttacgttacggttaaacgttccgggttacgggggaccgggtaaccgggttccgtaccggggtaacccggttacccgggaacccgtttacccggtaacccggttacccgaacccgggtacccggttacccccgg

SEQ ID NO: 376183 - DNA, 533 bp, Homo sapiens
  misc_feature: GZ8MTXP02IV2XT.10.72.G06.1.454.CMB.2.raw
  modified_base (164)..(164): a, c, t, g, unknown or other
  modified_base (241)..(241): a, c, t, g, unknown or other
  modified_base (288)..(288): a, c, t, g, unknown or other
  modified_base (302)..(302): a, c, t, g, unknown or other
  modified_base (346)..(346): a, c, t, g, unknown or other
  modified_base (401)..(401): a, c, t, g, unknown or other
  modified_base (441)..(441): a, c, t, g, unknown or other
tcagcatagtagtgcacgaccggtgctcgatttagctacgactgcaagggaaagggggtctcaggaggcagcgctctcgggacgtctccaccatggcctgggctctgctattcctcaccctcctcactcaggcacagggtcctgggcccagtctgccctgactnagcctgacttccgtgtctgggtcctcctggacagtcgatcactatctcctgcactggcaccagcagtgacataggtncttataactatgtctctgtaccaacaacacccagccaggcccccaanactcatctatttcntatgtacagtcgacgtcgtccgttggtactttactatctcttcnctcgctacgacgtcgtcgacaacgtacgtctcctcgactactcgtcggctcgacncgtagacgacgacgtactactattattcgcgcacgtctanataacaccaccgagctacgtcgtacgtagtactacgtcggacggtaacggtccgtagtcgtacgtaccgtacctacgactaccgaccgaacg

SEQ ID NO: 376184 - DNA, 803 bp, Homo sapiens
  misc_feature: GZ8MTXP02GA4JB.10.72.G06.1.454.CMB.2.raw
  modified_base (243)..(244): a, c, t, g, unknown or other
tcagcatagtagtgcacgaccggtgctcgatttagctacgactgcaaggggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcgtggacagtcgatcatatctcctgcactggccaccagcagtgacataggtnnttaataactatgtctcctggtaaccaacaaccacccagccacggcccccagacctcatctatttctgatgtctaggtgtaactccggtacccgtttagggtaccttttactaagttcgtcctttcgtccttcgtccctaccgaaacggttccgtacggacctaaacgtacccggtccctttacccgtacgaaacccctacgttccccggtcccggggtacccttccccgaacccggttcccgtaagggggaaccgggtaaaccggacgggttacccttaaagttaaacgttttaacctttaaccgtcgggtaaccgttaaccgtacccgttaaccttaaacgttaaacccgttaaacccccgaacccggggtaaaccggggtacccttaacccggtttaccggttaccggttaacggttaaaccggtttacgggttaacccgggggtaaccggggtaaccggggttacccggttacggggtaacccggtttacccgggtaacccccggttacccgtttaacccggtaacccggtaaacccggtaccccggtaaaccggg

SEQ ID NO: 376185 - DNA, 729 bp, Homo sapiens
  misc_feature: GZ8MTXP02G1UOR.10.72.G06.1.454.CMB.2.raw
  modified_base (240)..(240): a, c, t, g, unknown or other
  modified_base (250)..(250): a, c, t, g, unknown or other
  modified_base (323)..(323): a, c, t, g, unknown or other
tcagcatagtagtgcacgaccggtgctcgatttagctacgactgcaaggggaaagggggggggtctcaggaggcagcgctctcgggacgtctccaccatggcctgggctctgctattcctcaccctcctcactcagggcacagggtcctgggcccagtctgccctgactcagcctgacctccgtgtcgtgggtctccgtggacagtcgatcactatctcctgcacgtggcaccagcagtnacagtaggtntacttaatactatcgtctcctaggtaaccaacaaccacccgacggccaccggccccagacctcatctatttcngtattcgtactagtcgtacgtccggtaccgttttaggtacctttactaacgtcgtacctttctccgtcgtccccgtactaacgtccggtacgtaaccgtaaccgtaccgtcccttacccgtacgtaaccctcgttcccgggtacccggtcctacccgtaccggtacgtacggggaaaccgggtacgacgtacgtacttaaagtttactacgtagtaccgacgtacctataacttaacccgaaccgtacccgggtaacgggtacccttaccgttacggtacggttacgtaaacggtttcggggttaaacccgggggacgggtaccgggtaacccgtcggggtaacccgttacccggtaaccccggttaccgtaaccggtaccggaccccggtaaccgtaacccgggg

SEQ ID NO: 376186 - DNA, 536 bp, Homo sapiens
  misc_feature: GZ8MTXP02ICQHX.10.72.G06.1.454.CMB.2.raw
  modified_base (208)..(208): a, c, t, g, unknown or other
  modified_base (211)..(211): a, c, t, g, unknown or other
  modified_base (229)..(229): a, c, t, g, unknown or other
  modified_base (238)..(238): a, c, t, g, unknown or other
  modified_base (248)..(248): a, c, t, g, unknown or other
  modified_base (271)..(271): a, c, t, g, unknown or other
  modified_base (297)..(297): a, c, t, g, unknown or other
  modified_base (301)..(301): a, c, t, g, unknown or other
  modified_base (306)..(306): a, c, t, g, unknown or other
  modified_base (430)..(430): a, c, t, g, unknown or other
  modified_base (434)..(434): a, c, t, g, unknown or other
  modified_base (437)..(437): a, c, t, g, unknown or other
tcagcatagtagtgcacgaccggtgctcgatttagctacgactgcaaggggaaagggggggtctcaggaggcagcgctctcgggacgtctccaccatggcctgggctctgctattcctcaccctcctcactcagggcacagggtcctgggcccagtctgcctgactcagcctgactccgtgtctgggtctcctggacagtcatcactntcncctgcatgcacagcagtnacataggtncttataactngtctctggtaaccaacaacaccnggccacggccccagactcatcattcngatntcagnactcgtccttggtactttctatcgtcttctctcgtcctaccgtaagtcctaggccaaacgacgtccctccctacgacctctccgtccggcctcgacgcgtggacggagagctactattattacngcanctntatacacaccgacggctactcgtcgtgaacttcggtacggcggtaccggtacgtcggtaaccgtcgtaacccgtccgtaacgtccgacgacccgaacgg

SEQ ID NO: 376187 - DNA, 600 bp, Homo sapiens
  misc_feature: GZ8MTXP02IBKB5.10.72.G06.1.454.CMB.2.raw
  modified_base (476)..(476): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacgagggtcctgggcccagtctgccctgactcagcctgactccgtgtcgtgggtctcctggacagtcgatcactatctctgcatggcacagcagtgacagtaggtcgtacttataactatcgtctacctcggtaccaaacaaccaccacggccacgccccagactcatcattctgatgtctagtgtacgtcggtccgtttggtacttacgtaactcgtcttctctcgcctactaagtctcgacactacgtcctcctcgaactcgtccgtccggccctaccgacgtacgtacggacggtacgaacgtctactaacgtttattacgtcacgcgtctactaanactacgaaccgtgggactaccgtctacgtagtacgttacggtacgggtacgggaacggtaccgtacgggtcgtaccggtaaccccgtttccgaaccgttaccgtaaccggtaacccgacccggg

SEQ ID NO: 376188 - DNA, 686 bp, Homo sapiens
  misc_feature: GZ8MTXP02IM573.10.72.G06.1.454.CMB.2.raw
  modified_base (211)..(211): a, c, t, g, unknown or other
  modified_base (228)..(228): a, c, t, g, unknown or other
  modified_base (244)..(244): a, c, t, g, unknown or other
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctccgtggacagtcgatcactntctctgcactggcaccngcagtgacagtaggtntcttaataacttatcgtcttcctcggtaacccaaacaaccaccgacgccaaccggtccccagactcactctatttctgattgtctaggtacgtacgttccggtaccgtttagggttacctttactaacttcgtcttccttcttcgtccctacgtacgtctcggacctaacgaccggtccttacccgcgtaccctactcccgtccggggtcccctcccgtaaccggtcgttacgggaaaccggaccgggtacggtaccttacgttaaacgtttacgtttacgtacgtcgtaccgtacctacaaactttaacccaccgaacccggccggggtaactaccgtcgttacgtcgtaaacgttacgggttcggggaccggacgggttccggcggtaaccgttccgggtaacccgtccgtaccggtactaaccccggacgtaacccggg

SEQ ID NO: 376189 - DNA, 649 bp, Homo sapiens
  misc_feature: GZ8MTXP02IJ5K8.10.72.G06.1.454.CMB.2.raw
  modified_base (367)..(367): a, c, t, g, unknown or other
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgccactggcaccagcagtgacataggtgcttataactatgtctcctggtaccaacaacaccagccaggcccccagactcatcatttctgatgtcagtgactcggcctttgggacttttctaatcgctttctctcgcctcaagtctgccaacncggtcttccctgacccactcgtccggctccgacgcgtagagggaccgaggtcctacgtaatttacgttaaccgttcggactaacgtccttacctaaacttacgtaaaccccgacccgtaacgggggtaccttaaacccgttccgttaccggtttaggtaaacggtttaaacggtttaccgggggacccgggggtaaaacgggggtccccgttggggtaacccgttccgggtacccgttaccccggttaacgttcccggaacggtaacccccgtaaaccgggg

SEQ ID NO: 376190 - DNA, 544 bp, Homo sapiens
  misc_feature: GZ8MTXP01B9M3S.10.35.D02.1.454.CMB.2.raw
  modified_base (199)..(199): a, c, t, g, unknown or other
  modified_base (209)..(209): a, c, t, g, unknown or other
  modified_base (259)..(259): a, c, t, g, unknown or other
  modified_base (289)..(289): a, c, t, g, unknown or other
tcagcatagtagtgcacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgctccgaggggaaangcccaccctntcctgcagggccagtcactatgttagtgaacaactacttagccttggttncagcacaactggccaggctccaggctcctnatctatgctgcatccatcgacgggccagtggcactccaggcagacttcagtgcagtgggtctgggacagacttcactctacaccatcagcagacgtggacgcctagtaagtatttgctagtacttagttactgtacagacagtatggtaccacgtaccgtaagtacgtttcgggaaccgtaaggggaccaaggcgtagggacgttaacgttacaaacggtaacgtggtaacggcttcggactaaccgttcgttcg

SEQ ID NO: 376191 - DNA, 503 bp, Homo sapiens
  misc_feature: GZ8MTXP01ATLXY.10.35.D02.1.454.CMB.2.raw
  modified_base (198)..(198): a, c, t, g, unknown or other
tcagcatagtagtgcacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgctccaggggaaanagccaccctctcctgcagggccagtcactatgttagtgacaactacttagcctggttgcagcacaactggccaggctccaggctctcatctatgctgcatccatcagggccactggcatcccaggcagacttcagtggcagtgggtctggggacaggacttcactctcaccatcagcagactggagcctagaagtatttgcagtctattactgtcagcagtatggtcacgtcccaagtaacgtttggccaaggggaccaaagcgtaggagattcgaaacgaactgtggctgacaaccgaattccg

SEQ ID NO: 376192 - DNA, 578 bp, Homo sapiens
  misc_feature: GZ8MTXP01CH5X5.10.35.D02.1.454.CMB.2.raw
  modified_base (273)..(273): a, c, t, g, unknown or other
  modified_base (279)..(279): a, c, t, g, unknown or other
  modified_base (366)..(366): a, c, t, g, unknown or other
  modified_base (428)..(428): a, c, t, g, unknown or other
  modified_base (445)..(445): a, c, t, g, unknown or other
  modified_base (479)..(479): a, c, t, g, unknown or other
  modified_base (576)..(576): a, c, t, g, unknown or other
  modified_base (578)..(578): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctggaaatgagcagccnggaaancgatgaacacaggactctattattgtaccactaagacgtccccaagaagactggtagggaagggactggcgtcgggggccaggggcncccgttgtccaccgtctcctcagccctccaccaagggcccatcggtcccttccccgtggccnccctgcctccgaggacnccacctccgacgacgggcacgacgcccggcccgnggggcctggccccgtggtaccgaaacgggtccttaacccttccccaacttacctagttcggtacctggacggcggggctgggaccaagggcgcatgngn

SEQ ID NO: 376193 - DNA, 659 bp, Homo sapiens
  misc_feature: GZ8MTXP01DV724.10.35.D02.1.454.CMB.2.raw
  modified_base (656)..(656): a, c, t, g, unknown or other
  modified_base (658)..(658): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaaagaacaccgtgtatctaggaaatgagcagccaggaaagcgatgacacaggactctattatgtaccataaagactcccaagaagactggtagggaagggactggcgtgggggccaggggacgcccttgtaccacccggttcctccctccacgccctacccaaccgaaacggggccccagtcccggtccttccccccgtggcccgtcccctcggccttcccgaacgggacgcccaaccccgtccgaacgacggggaccaaccgaacggcccgggccccgtggggccttcggcccgttcgggtaccaaacgggtacctaacccttcccccaaacttaccctaaagttcggaccgttggaacggccgggggttacgtaacggggacccgaaagggggccaccgttaagtaacggngng

SEQ ID NO: 376194 - DNA, 606 bp, Homo sapiens
  misc_feature: GZ8MTXP01DFBX7.10.35.D02.1.454.CMB.2.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgctaattttaaaaggtgtccagtgtgacgtgcagttggtggagtcgtgggggagcgttgggtaaggccggggggtccttagactctcctgtcagcctctggattcagtgtcactaacgcctggatgagctgggtcccgcacgtccccgaggggagggctggagtgggtgccttagttagagcagacctgagtggtagggacaacgagagtaacgcgtggaatttacggtaaaaaggcaagacttcgacctatctactaatgatagaagtacaaagacaccgtatatacgtaggaaagtgagtacagaccgtaggaaacgcgaagtcgaacacgaacggtacttaacttaatttaattacgttaaacctaaacgtaacgaacgttcccaaacggtaaagaccgtgggtaacggggaacgggactcgggcggtaaccggggg

SEQ ID NO: 376195 - DNA, 544 bp, Homo sapiens
  misc_feature: GZ8MTXP01BSJ4H.10.35.D02.1.454.CMB.2.raw
  modified_base (201)..(201): a, c, t, g, unknown or other
  modified_base (211)..(211): a, c, t, g, unknown or other
  modified_base (258)..(258): a, c, t, g, unknown or other
  modified_base (285)..(285): a, c, t, g, unknown or other
  modified_base (291)..(291): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaanagccaccctntcctgcagggccagtcactatgttagtgacaactacttagcctggtncagcacaactgcaggctccagctcctnatctangctgcatccatcgagggccacgtggcatcccgaggcagtacttcgagtgcaggtgggtctgggacagtaccttcactctcaccatcagcagactaggacgcctagaagtatttcgactagttcttagttacgtgtacagactagtagtgtacctacgtacccgtaagttacgtttggaaccgtagggggaccaaaggttcgtaggacacgttacgaaacgtaacgtggtcgctaggacctaacttaacgttcg

SEQ ID NO: 376196 - DNA, 591 bp, Homo sapiens
  misc_feature: GZ8MTXP01AHK8Q.10.35.D02.1.454.CMB.2.raw
  modified_base (273)..(273): a, c, t, g, unknown or other
  modified_base (588)..(588): a, c, t, g, unknown or other
  modified_base (590)..(590): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgcatctcaattgatgagtcaaagaacaccgtgtatctaggaaatgagcagccnggaaagcgatgacacaggactctattattgtaccactaagagtcccagaagactggtagggaaggactgcgtcggggccaggggacgccccttgccacccgtctcccgtcacgccctacccaccgaacgggccccacgtccggtccttcccccgcggcccgtccctcgcctccgacggacgccaccgtccgagacgggcacgacgccggcccgtgggctcgccgtggtccaacggtacctcctaaccccacttaccgtattcggtcctcggacggttcggggcccttggggaccgaacgggccggacgacgtcgngng

SEQ ID NO: 376197 - DNA, 638 bp, Homo sapiens
  misc_feature: GZ8MTXP01EBYL5.10.35.D02.1.454.CMB.2.raw
  modified_base (200)..(200): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcacctgtctttgtctccgaggggaaanagcccaccctctcctgcagggccagtcactatgttagtgacaactacttagcctggttgcagcaacaaactggccaggctccgaggctcctcatctatgctgcatccatcgagggccactggcactcccaggcagacttcaggtggctaggtcgggtcgtggggactaggtaccttcgactctacaccactcagcgagacgtggacgccttaggaagttagtttcgacgtagttcttaagttacttggtactacgtacgtaagttacgtcggtaccgtaaccggttacccgtaaacgttaaccgttttacggggaacccggtaacgggggttaaaccctaaaggttaccgtaacggggtaaacgttaacgttaaccgaaaaccggttaacggtacggtaacgggtacgttacggaccgtaaccgttaacgtttaaccg

SEQ ID NO: 376198 - DNA, 623 bp, Homo sapiens
  misc_feature: GZ8MTXP01AXHTK.10.35.D02.1.454.CMB.2.raw
  modified_base (461)..(461): a, c, t, g, unknown or other
  modified_base (480)..(480): a, c, t, g, unknown or other
  modified_base (621)..(621): a, c, t, g, unknown or other
  modified_base (623)..(623): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattacgtaaaaggcagattcgccatctcaattgatgagtcaaagaacaccgtgtatctaggaaatgagcagcctaggaaagcgatacgacacaggtactctattatcgtaccaactaagacgtacccacgaatacgtggtagggaaacggactcgcgtacggggccaggggacgtccccgttgtacccacccggttctccctacgacgtcccctaccaaccgaaacgggccctacgtccggtccttcccccgtggcccnccctcgcctcgacggaccnccgaccgacgagacgacgacgccgccggtccgtggccgtcgtaccgtcggtaccgaacggtcccttacctaaccctaacgttactacgttcggtcgtcggacgggccgggacggtcggacgaacggcgtacgacgtaacgngn

SEQ ID NO: 376199 - DNA, 592 bp, Homo sapiens
  misc_feature: GZ8MTXP01EDXSZ.10.35.D02.1.454.CMB.2.raw
  modified_base (258)..(258): a, c, t, g, unknown or other
  modified_base (347)..(347): a, c, t, g, unknown or other
  modified_base (541)..(541): a, c, t, g, unknown or other
  modified_base (574)..(574): a, c, t, g, unknown or other
tcagcatagtagtgcacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgttctttgtctccaggggaaagagcccaccctctcctgcagggccagtcactatgttagtgacactacttagcctggttncagcacaaacctggccaggctcccaggctcctcatctatgctgcatcccatcagggccacttggccatccccaggaccagatttcgagngggtcacggtggggtcttggggaacagtacctttcacctctcaaccactcagcaggacttggacgccgtgaacgtatttgctacgttcttatttaacttgtcacgactagtaagttggttacccgccgtaaccccttaaggtaaacccgttttgggaacccggtaacggggacccgtaaaggcgttacgggaanacgttccaaaacgtaactgggtaacgtcggtanacctaacgttaaccttcg

SEQ ID NO: 376200 - DNA, 567 bp, Homo sapiens
  misc_feature: GZ8MTXP01AZPPR.10.35.D02.1.454.CMB.2.raw
  modified_base (274)..(274): a, c, t, g, unknown or other
  modified_base (424)..(424): a, c, t, g, unknown or other
  modified_base (444)..(444): a, c, t, g, unknown or other
  modified_base (560)..(560): a, c, t, g, unknown or other
  modified_base (565)..(565): a, c, t, g, unknown or other
  modified_base (567)..(567): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagccnggaaagcgatgacacaggactctattattgtacactaagatcccagaagactgtagggaaggactggctgggggccaggggacgcccttgtccaccgtctcctcagccctccaccaacgggccccactccggtccttcccccgtgggccncccctcgcctccacgggacnccaccctccgacgagggcaacgacggcccggcccgtggggcctcgcctgggtccaaaggaccttacgttccccaacttactattcgactggacgttcgggctgggccaaggccganagtgngn

SEQ ID NO: 376201 - DNA, 607 bp, Homo sapiens
  misc_feature: GZ8MTXP01A0SD4.10.35.D02.1.454.CMB.2.raw
  modified_base (605)..(605): a, c, t, g, unknown or other
  modified_base (607)..(607): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattatgtaccactaagacgtcccaagaagactggtagggaagggactggcgtcgggggccagggggacgcccttggtccacccgtctccctcacgccctaccaccgaacgggccccagtccggtcccttcccccgtcggcccgcccctcgcctccgacgggacgcccacccgtccgacgacgggccaacgcggcccgggcccgtggggcctcggcccgttgggtaccaaacgggtaccttaccgttccccaacttacctagttcggccgtggacgggccgggcgtgggaccgaagggccgagataagngn

SEQ ID NO: 376202 - DNA, 555 bp, Homo sapiens
  misc_feature: GZ8MTXP01DV2TG.10.35.D02.1.454.CMB.2.raw
  modified_base (275)..(275): a, c, t, g, unknown or other
  modified_base (424)..(424): a, c, t, g, unknown or other
  modified_base (446)..(446): a, c, t, g, unknown or other
  modified_base (553)..(553): a, c, t, g, unknown or other
  modified_base (555)..(555): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctaggaaatgagcagccnggaaagcgatgacacaggactctattattgtaccactaaagagtacccagaagactggtagggaaggactgcgtcggggccaggggacgcccttgtccaccgtctcctcacgccctccaccaagggacccagtccggtccttcccccgnggccgccctgcctccgaggacnccacctccgagacggcacgacgccggcccgtgggcctggcccgtcggtcaacggtacctaccttcccacttactattcgctgcgcgggcgtggcaaggcgcataagngn

SEQ ID NO: 376203 - DNA, 577 bp, Homo sapiens
  misc_feature: GZ8MTXP01DNHSX.10.35.D02.1.454.CMB.2.raw
  modified_base (202)..(202): a, c, t, g, unknown or other
  modified_base (213)..(213): a, c, t, g, unknown or other
  modified_base (239)..(239): a, c, t, g, unknown or other
  modified_base (259)..(259): a, c, t, g, unknown or other
  modified_base (286)..(286): a, c, t, g, unknown or other
  modified_base (382)..(382): a, c, t, g, unknown or other
  modified_base (411)..(411): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaaggggaaancgcccaccctntcctgcagggccagtcatatgttagngaacaactactagcctggtncagcacaactggcaggctccagctctnatctatgctgcatccatcgagggccacgtggccactcccgaggcagtacttcgagtggctaggtcgggtctgggactagtaccttcactctcaccntcagcagacgtggacgtctagtaacgttnttagactagttacttagttacgtgtactagtacgtagtgtaccgtaacctaaccgtaaccgttaaaggttaccgttcgggaaaccggtaacgggactaaggttacgtaggaacgttaacgttaacgaaacgtcgtaggtcgacgtacgacctaacgttaacgttcg

SEQ ID NO: 376204 - DNA, 670 bp, Homo sapiens
  misc_feature: GZ8MTXP01ALEL5.10.35.D02.1.454.CMB.2.raw
  modified_base (200)..(200): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangcccaccctctcctgcagggccagtcactatgttagtgaacaactacttagcctggttgcagacacaaaccgtggccaggctcccgaggctcctcatctatgctgcatccatcgacgggccacgtggccactcccgaggcagtacttcgaggtggcagggtcgggtacgtggggactaggtacttaccgattcctacacactcacgacaacggtaactgggacgaccgttagggtaaacgttacgttttacgacttacgtttaccttaacgtttaacgttgggttaccaacggtaccgtaagggttaacgtcggggttaacctacccgggttaaccctaaacggttaaaccggttttcgggaacccggttaacgggggacccaaagggttccggtaaggaacgaccgttaacgttaaaaccgggtaacgtcgggtaacggttcctacgggaccaacccggtttcgttccg

SEQ ID NO: 376205 - DNA, 607 bp, Homo sapiens
  misc_feature: GZ8MTXP01AQPM3.10.35.D02.1.454.CMB.2.raw
  modified_base (255)..(255): a, c, t, g, unknown or other
  modified_base (455)..(455): a, c, t, g, unknown or other
  modified_base (486)..(486): a, c, t, g, unknown or other
  modified_base (566)..(566): a, c, t, g, unknown or other
  modified_base (607)..(607): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattacgtaaaaggcagattcgccatctcaattgatgagtacaaagaacacgtntatctagaaatgagcagcaggaaagcgaatgacacgaggacttctattatagtaccaactaagacgtacccaacgaagtacgtggtagggaaggactggcgtcgggggaccaggggaccgtcccgttggtacccacccgttcctcccgtccacgcccctaccgaccgaacgggcccctacgtccgttccccttcccccgnggcccgtcccgtacggccctccgagggaccnccaccgtccgagacggccaacgcgcccgggccgtgggcctcgcccgtggtaccgaacgtctacccctcgaacttcttacncggacctggacgggcgcgtaacggcaacggcacttagtggn

SEQ ID NO: 376206 - DNA, 620 bp, Homo sapiens
  misc_feature: GZ8MTXP01BDJAV.10.35.D02.1.454.CMB.2.raw
  modified_base (202)..(202): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaaggggaaancgcccaccctctcctgcagggccagtcacttatgttagtgaactaactacttagccttgggttgcagcaaccaaaccgtgggacccagggcctaccccgaggcctcctctatcctatgcctgcatccatcgagggccatggctactcccaggtcagacttcgaggtcgcgtaggtcgggtctgggacaggtaccttcgactccacaccatacagacagacgtgggactcctagtaacgtgtttgctaagttccttagttacgtagtacctaaggtcctaagttcgtaggtaccctacgtaacccgtaaagttaccggttcggaaccgtaacggggacctaaaggttcgaagggtaacttaacgttacgttaaaccggaagtcgggtaacggtctacggaccttaacgttaactttccg

SEQ ID NO: 376207 - DNA, 850 bp, Homo sapiens
  misc_feature: GZ8MTXP01CBDE3.10.35.D02.1.454.CMB.2.raw
  modified_base (847)..(847): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgcatctcaattgatgagtacaaagaacaccgtgtatctaggaaatgagcagcctaggaaagcgatgacacaggactctattattgtaccataacgagtacccaagaagactaggtagggaaggacgtggcgtcgggggaccagggggacgtcccccgtttaggtacccctacccgggttcccttccccgtaccgaaccgggtcccccttaccccgaaaccccgaaacggggggtaccccccctaacgtttccccggggtttccccctttcccccccgggttacggggcccccggttaccccccgtttaccgggccccgtttaccccggaaacgggggacccggtacccccgaaaccccccggttaccggggaaacccggaacccgggggacccgaaaacccggggacccggggccccccggggtaccccgggttccgggggtcccgtaccgggtttccccggggtaccgggttaaacccggaaacccgggtttacccctttaaccccctttaaccccgtaaaccttaaccggttaacgttcggtacggttaacgggaccgggggttccgggaccgggttaacgggaacccggtaaacgggggcccggtaaacgttaacggtaacgngcg

SEQ ID NO: 376208 - DNA, 714 bp, Homo sapiens
  misc_feature: GZ8MTXP01DE33Y.10.35.D02.1.454.CMB.2.raw
  modified_base (290)..(290): a, c, t, g, unknown or other
  modified_base (711)..(711): a, c, t, g, unknown or other
  modified_base (713)..(713): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattacgtaaaaggcagattcgcatctcaattgatgagtacaaaagaacacgtgtatctaggaaatgagcagccaggaaagcgatgacanagactctattattgaaccaataaagacgtacccaacgaaagactggtagggaaggactggcgtcgggggacccaggggacgtcccctttggtacccgaacccgttcctccctaccgaaccggtccccctaccccgaaccccgaaacggggtccccctaacgttccccgggttcccctttcccccccggtcgggccccgtcccccgttaccggcccttaccccgaacgggacccgcccaaaccccgttccggaacgaccggacccgtaacccgaccgggccccgggccccgttcggggccgtccggtacccgtacgggtaacccgaaacgggtaaccccttacccgtttaacccctaacttaccgtacgttcgaccgttagggacgggttccgggccgtcggggacgaacgggcgcaagtgngng

SEQ ID NO: 376209 - DNA, 555 bp, Homo sapiens
  misc_feature: GZ8MTXP01C18O8.10.35.D02.1.454.CMB.2.raw
  modified_base (141)..(141): a, c, t, g, unknown or other
  modified_base (200)..(200): a, c, t, g, unknown or other
  modified_base (385)..(385): a, c, t, g, unknown or other
  modified_base (409)..(409): a, c, t, g, unknown or other
  modified_base (441)..(441): a, c, t, g, unknown or other
tcagcatagtagtgcacgaccggtgctcgatttagcacacgatagttgggtttggggagctgctcagttaggacccagagggaaccatggaaaccccagcgcagcttctcttcctcctgctactctggctcccagaaaccnccggagaagttgtgttgacgcagtctccaggcaccctgtctttgtctccgaggggaaancgcccaccctctcctgcagggccagtcactatgttagagactaactacttagcctggttgcagcacaactgccaggctccagctctcatctatgctgcatccatcaggccactggcatcccaggcaggacttcgaggtggctaggtcgggtctggggactacggtacttcacgtctcaccatcanacagacctaggatccgtagaagtntttgctagtctattactgtaccaggtctagtntcggtactacgtacccaaggttaacgtttgggaacccgtaggggaccctaaggcgtaagggacggacttacgaaacggtaacgtggtcgttgacggactaaccgttaatttccg

SEQ ID NO: 376210 - DNA, 583 bp, Homo sapiens
  misc_feature: GZ8MTXP01D8T12.10.35.D02.1.454.CMB.2.raw
  modified_base (180)..(180): a, c, t, g, unknown or other
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaggngtccagtgtgacgtgcagttggtggagtcgtgggggaggcttgggttaaggccggggggtcccttagactctcctgttcagcctctggattcagtgtcactaacgcctggatgagctgggtccgccagtccccaggggaagggctggagtgggttggccttagttagaagcagacctgatggtagggacaacgagacgtaacgctggattacgtaaaaaggcaaggattcgacctatctcaattgatgaagtacaaagaacaccgtgtaatcgtaggaaagtgagcaagcctaggaaagcgaagtgaacacacggctaactattacgttattacctaacgtaacgttaacgttcccaaccgaagtaacctgggtagggaacgggacgttggccgtaacggggg

SEQ ID NO: 376211 - DNA, 619 bp, Homo sapiens
  misc_feature: GZ8MTXP01A5HUA.10.35.D02.1.454.CMB.2.raw
  modified_base (616)..(616): a, c, t, g, unknown or other
  modified_base (618)..(618): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctaggaaatgagcagccaggaaagcgatgacacaggactctattattgtaccactaagacgtacccagaagactggtagggaacgggactggcgtcgggggccgaggggacgtcccttggtacccacccgttcctccctcacggtcccctaccgaaccgaaacgggccccagtcccggtcccttcccccgtggcccgccctcgcctccgacggacgccaccgtcgagacggcaccgacgcccgggccctggggccttcggccgtcgggtacaacggtccctacccttaacccaacttactacttcggtactacggacggttccggggcgttaacgggacgaacgggccgacgaagtcgngng

SEQ ID NO: 376212 - DNA, 616 bp, Homo sapiens
  misc_feature: GZ8MTXP01CQZL2.10.35.D02.1.454.CMB.2.raw
  modified_base (199)..(199): a, c, t, g, unknown or other
  modified_base (284)..(284): a, c, t, g, unknown or other
  modified_base (355)..(355): a, c, t, g, unknown or other
  modified_base (361)..(361): a, c, t, g, unknown or other
  modified_base (381)..(381): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctccagaaaccacggagaagttgtgttgacgcagtctccaggcaccctgtctttgtctccgaggggaaanacgccaccctctcctgcagggccagtcactatgttagtgaacaactacttagcctggttgcagcacaactgcagctccagctccnatctatgctgcatcaccccctgacgggccacgtcggcactcccgagcagtacttcagtgcgaggtcgggtncggganagtactcactctcacatcancgagactgggactaccgtagtaaacgttagtttacggactaggtttaccttaaggggtttaaccctggttaactaacgtacgtaagttacgttcgggtacctaaaccgtacccgtaaaaggttaccgttttggggaacccgtaagggggaaccctaaggccgttaaggggaacttaacgttacgttaaaacggtaaccgtagggtcgtacgtcggacctaacgttaactttccgg

SEQ ID NO: 376213 - DNA, 667 bp, Homo sapiens
  misc_feature: GZ8MTXP01DMVKQ.10.35.D02.1.454.CMB.2.raw
  modified_base (202)..(202): a, c, t, g, unknown or other
  modified_base (261)..(261): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaaggggaaanacgcccaccctctcctgcgagggccagtcatatgttagtgactaactacttagctggtncagcaacaactggaccaggcctccgagctcctcatctatgctgcactccatcgacgggccacgtcggcacgtcccgagcagtactcgaggtcggacgtaggtcgggtctgggactacgtaccttcgactcctacaccatcgacgcagtacgtaggacgtcgtaagtagttatttacgacttacgttacttacgtttacgtacgtacgtacgtacgtaagttacgtacggttaccaccggttaaccgtaaacgtttaaccggttttcgggaaccgggtaaacgggggttaccgtaaacgggttacggtaaacgggtaacgttaaaccgttaaaccggttaaaacgggttaaccgtacggggttaacggtacgtaccgggttacccttaaaccgttcgtttaacccgg

SEQ ID NO: 376214 - DNA, 663 bp, Homo sapiens
  misc_feature: GZ8MTXP01DBMCU.10.35.D02.1.454.CMB.2.raw
  modified_base (268)..(268): a, c, t, g, unknown or other
  modified_base (277)..(277): a, c, t, g, unknown or other
  modified_base (281)..(281): a, c, t, g, unknown or other
  modified_base (457)..(457): a, c, t, g, unknown or other
  modified_base (489)..(489): a, c, t, g, unknown or other
  modified_base (661)..(661): a, c, t, g, unknown or other
  modified_base (663)..(663): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtcccgccagtccccagggaaggggctggagtgggttggccttattagaagcagacctgatggtggacaacagagtacgctggattacgtaaaaggcagattcgcatctcaattgatgatacaaagacacgtgtatctagaaatgagnagcaggaancgangacacagactctattattcgaaccactaagacgtaccccaagaagacgtgggtagggaaacgggacgtggcggtaccggggaccgaggggacgtcccgttagtacccacccggttctccctcaaacgccctacccacggtaacgggcccctagttcccgggtcccctttccccggnggccccgtccccgtgtccctaccgacgggacnccccaacccgtccgaagacgaccgaaccggaccgggcccggtccccgtgggccctttcggacccgttcgggtaacctaaccgggtacccttaacccttccccaaggttaaacctcgttcggtacggtcggacgggttcgggacgtcgggacaacgggcccggattaaggtgngn

SEQ ID NO: 376215 - DNA, 649 bp, Homo sapiens
  misc_feature: GZ8MTXP01CARZ5.10.35.D02.1.454.CMB.2.raw
  modified_base (200)..(200): a, c, t, g, unknown or other
  modified_base (259)..(259): a, c, t, g, unknown or other
  modified_base (287)..(287): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgctccgaggggaaanagcccaccctctcctgcagggccagtcactatgttagtgaacaactacttagcctggtncagcacaactggccaggctccgagctcncatctatgctgcatccatcgaggccacgtgcactcccgaggcagtacttcgaggtggctaggtcgggtctggggactaacgtacctttcacttcctacgacctatacacgacgagacgtaggacgtcgtagtaagtactttgactacgttacttaacgttacttagtctaacgtcgtaagtacggttacggtacccgtaaccggttacccgtaaacggttaaccgtttcgggaacccggtaaacggggttaacccgtaaacggttacggttaacggaacggttaaacgttaaccggaaaaccggttaaccggttagggtaacgggttacccgtacggttaacccgtaaccgttcgttaaccg

SEQ ID NO: 376216 - DNA, 590 bp, Homo sapiens
  misc_feature: GZ8MTXP01BTWHR.10.35.D02.1.454.CMB.2.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcaggttggtggagtcgtgggggaggcgttgggttaaggccggggggtccttagactctcctgttcagcctctggattcagtgtcactaacgcctggatgagctgggtccgccagtccccgaggggaacgggctggaggtgggtggtacctttagttagaagcagacctgagtggtggacaacgagagtaacgctggattacgtaaaagcaagacttcgccagtctacaatgaatgaacgtacaaaacgacaccgtagtaatacgtaaggaaagttgaagtacaggaccgtaagggaaacgcgaatcggaaacacgtaggactaacgtattagttacgttacaacgtaagacgttccaacgaagacgtggtacgggaggttactcggcgtcgggg

SEQ ID NO: 376217 - DNA, 684 bp, Homo sapiens
  misc_feature: GZ8MTXP01BR2ZY.10.35.D02.1.454.CMB.2.raw
  modified_base (181)..(181): a, c, t, g, unknown or other
tcagcatagtagtgcacgaccggtgctcgatttagcacacgatagttgggtttggggctgggagaggagccccagccctgggattcccaagtgtcttcattcagtgatcaggactgaacacagaggactcaccatggagtttggctgaggtggattttcctgctgactaattttaaaaggngtccagtgtgacgtgcaggttggtggagtcgtgggggaggtcgtttgggttaaggcccggggggttccttagaccttcgtcctgttcacgtcctctggtattcagtgtcaactacgctggatgagcgtcggtccgccgacgtccccgaggggacgggcgtcgggaggtgggttcgtacctttaagttacgaagcgagtaccgtgaacgtcgggtacggaacaacgagtacgtaaccgagtcggtagttaacgggaaaaggctaaggtacgttccgacctagttacctacgtaagttacgaagttgaaacgttacaaagtaaccgtaaccgttgtaactacgttaaggaaacgttggaacgtcgaacggacccgtaaggaaaccgacgagtacgaccgtaaacgcggtactaacctttaaattacgttaacgaccgtaaacgtaacgaccgttaccgaacgtaacgtcgtaagggacgggaaggttcgtcgggcggtaacgggg

SEQ ID NO: 376218 - DNA, 700 bp, Homo sapiens
  misc_feature: GZ8MTXP01CG52M.10.35.D02.1.454.CMB.2.raw
  modified_base (260)..(260): a, c, t, g, unknown or other
  modified_base (297)..(297): a, c, t, g, unknown or other
  modified_base (697)..(697): a, c, t, g, unknown or other
  modified_base (699)..(699): a, c, t, g, unknown or other
tcagcatagtagtgcacgaccggtgctcgatttagcacacgatagttgggtttggggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagacaccgtgtatcnggaaatgagcagccaggaaagcgatgacacaggactntattattgtaccactaagagtcccacgaagactggtgggaagggactgcgtcggggcaggggagccccttgtccacccgtctccctcacgccctcccgaccgaacgggcccctactccggttccccttccccccgtcgggtccccgccccgtcggtccccgttaccccgacggggaaccgcccgaacccccgttaccgaaccggacgggtacccgaaccggacccggtccccgggtcccggtcggggtacccgtccggtaacccggttccggtaacccggaaccggtaacccttaccccgttaaccccgtaacctttaaccgtacgttaccgtccggttacgggacggggttccgggttccgggtcgggaacgggaaccggtcggaccgttaaggtcggngng

SEQ ID NO: 376219 - DNA, 490 bp, Homo sapiens
  misc_feature: GZ8MTXP02J3KZH.10.35.D02.1.454.CMB.2.raw
  modified_base (199)..(199): a, c, t, g, unknown or other
  modified_base (208)..(208): a, c, t, g, unknown or other
  modified_base (256)..(256): a, c, t, g, unknown or other
tcagcatagtagtgcacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctntcctgcagggccagtcactatgttagtgacaactacttagcctggttncagcacaaacctggccaggctcccaggctctcatctatgctgcatccatcagggccatggcatcccaggcagattcagtggcagtggggtctggggacagacttcactctcaccatcagcagactgagcctgaagatttgcagtctatactgtcagcagtatggtcacgtccaagaacgtttggccagggaccaagctggagactacaaacgaacgtgtcggctcgcaccatcg

SEQ ID NO: 376220 - DNA, 538 bp, Homo sapiens
  misc_feature: GZ8MTXP02GQ5XY.10.35.D02.1.454.CMB.2.raw
  modified_base (537)..(538): a, c, t, g, unknown or other
tcagcatagtagtgcacgaccggtgctcgatttagcacacgatagttgggtttgggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagacaccgtgtatctggaaatgagcagcctggaaagcgatgacacaggactctattattgtaccactaagagtcccacgaagactgtgggaaggactggcgtggggccaggggacgccccttggtccaccggtcctcctcacgccctccaccgaacgggccccatccggtccttcccccgtggcccgccctgcctccaggacgccacctccgagacgcacacgccggccctgggcctcgcctggtcaaggctacttcccactactactgctgacgcggctggcaaggcgcatacgnn

SEQ ID NO: 376221 - DNA, 523 bp, Homo sapiens
  misc_feature: GZ8MTXP02FW8LK.10.35.D02.1.454.CMB.2.raw
  modified_base (517)..(517): a, c, t, g, unknown or other
  modified_base (520)..(520): a, c, t, g, unknown or other
  modified_base (522)..(523): a, c, t, g, unknown or other
tcagcatagtagtgcacgaccggtgctcgatttagcacacgatagttgggtttgggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattatgtaccactaagagtcccagaagactggtgggaaagggactggctggggccaggggagcccttgtccaccgtctcctcagccctccaccaagggccccatcgtccttccccctggccgccctgcctccgaggacgccacctcccgagacgccacagccggccctgggctgcctggcaaggctacttcccatactatgctgacgcgggctggcaaggcncanann

SEQ ID NO: 376222 - DNA, 560 bp, Homo sapiens
  misc_feature: GZ8MTXP02HLV22.10.35.D02.1.454.CMB.2.raw
  modified_base (559)..(560): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagacacgtgtatctggaaatgagcagcctggaaagcgatgacacaggactctattattgaccactaagagtccccagaagactggtgggaaagggactggctggggccaggggacgcccttgccacgtctcctcacgccctccaccgaacgggccccatccggtcccttcccccgtgggcccgcccctgcctccgaggacgccaccgtccgagacgcacgacgccgggccctggggcctcggcccgtggtaccaacgggtactaccgttcccactacctactcgcctgacgcgggctcgggcaacggcgcacgtcgnn

SEQ ID NO: 376223 - DNA, 598 bp, Homo sapiens
  misc_feature: GZ8MTXP02I4ATO.10.35.D02.1.454.CMB.2.raw
  modified_base (200)..(200): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaacttactagcctggttgcagcaacaacctggccaggcctccaggctcctcatctatgctgcatccatcgacggccacgtgcactccgaggcagtactcagtcgctaggtgggtctggggacaggtacttcgactctacaccatcagcagactggactccgtagaagttatttcggactaggttacttaagttacttgtacagtcgtaagttagtcggtacaaccgttacctaaagttaacgttttcgggacccgtaacggggaacccgtaaggtaccgttacgggaacgtaacttaacccgaaaaaacggtccgttaagggtcgggtacctacggacccgtaacctacggtttacccg

SEQ ID NO: 376224 - DNA, 563 bp, Homo sapiens
  misc_feature: GZ8MTXP02HOFT5.10.35.D02.1.454.CMB.2.raw
  modified_base (198)..(198): a, c, t, g, unknown or other
  modified_base (257)..(257): a, c, t, g, unknown or other
  modified_base (275)..(275): a, c, t, g, unknown or other
  modified_base (277)..(277): a, c, t, g, unknown or other
  modified_base (283)..(283): a, c, t, g, unknown or other
  modified_base (291)..(291): a, c, t, g, unknown or other
  modified_base (293)..(294): a, c, t, g, unknown or other
  modified_base (298)..(298): a, c, t, g, unknown or other
  modified_base (301)..(301): a, c, t, g, unknown or other
  modified_base (309)..(309): a, c, t, g, unknown or other
  modified_base (315)..(315): a, c, t, g, unknown or other
  modified_base (322)..(322): a, c, t, g, unknown or other
  modified_base (326)..(326): a, c, t, g, unknown or other
  modified_base (329)..(329): a, c, t, g, unknown or other
tcagcatagtagtgcacgaccggtgctcgatttagcacacgatagttgggtttggggagctgctcagttaggacccagagggaaccatggaaacccagcgcagcttctcttcctcctgctactctggctcccagaaaccaccggagaagttgtgttgacgcagtctccaggcaccctgtctttgtctccaggggaaanagccaccctctcctgcacgggccagtcactatgttagtgacaactacttagcctggttncagcaacaactgcacgcncncgctcncatctatncnncacncancgcgcacncgcacncacgcanactnagngcgtgtggtcgtggacgagtactactactctacacactacacgacacgacgtacgacgtacgtacgtaagtagttacgtacgtacgttacttacttacttacgtacgtacgtacgtacgtacgtacggtacgtaccgtaccgtaacgtaacgttacggtacggtacgggaacgaacgacgtacggacgaacgtaacgaaacgtaacgtacggtacgtacgtacgacactactcg

SEQ ID NO: 376225 - DNA, 583 bp, Homo sapiens
  misc_feature: GZ8MTXP02JIMS1.10.35.D02.1.454.CMB.2.raw
  modified_base (366)..(366): a, c, t, g, unknown or other
  modified_base (582)..(583): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattatgtaccactaagagtccccaagaagactggtaggggaaagggactggcgtgggggccaggggacncccgttgccaccgtctcctcacgccctccaccaacgggcccactccggtccttcccccgtggccgccctcgcctccgaggacgccacctccgagacgcacgacgccgggcccctggggcctcggcccgtggtaccaaagggtacctaaccttccccaacttacctaacttcgccttcggacggccggggcctgggaccaaagggccgcacgtacgnn

SEQ ID NO: 376226 - DNA, 527 bp, Homo sapiens
  misc_feature: GZ8MTXP02IHVBK.10.35.D02.1.454.CMB.2.raw
  modified_base (199)..(199): a, c, t, g, unknown or other
  modified_base (208)..(208): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaangccaccctntcctgcagggccagtcactatgttagtgacaactacttagcctggttgcagcacaactggccaggcctccaggctcctcatctatgctgcatccatcagggccactggcactcccgaggcagattcgagtggcaggtgggtctggggacagacttcactctcaccatcagcagactggacgcctagaagtatttgctagttcttaattactgtacagcagtatggtcacgtaccctaagtacgtttggaccgacgggacacgtcgtaggacgactacgaaaacgtaacgtcggtacggtctacgacctaccgtacttcg

SEQ ID NO: 376227 - DNA, 512 bp, Homo sapiens
  misc_feature: GZ8MTXP02HSBQ2.10.35.D02.1.454.CMB.2.raw
  modified_base (197)..(197): a, c, t, g, unknown or other
  modified_base (205)..(205): a, c, t, g, unknown or other
  modified_base (252)..(252): a, c, t, g, unknown or other
  modified_base (281)..(281): a, c, t, g, unknown or other
tcagcatagtagtgcacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtcttgtctcaggggaaangccacctntcctgcagggccagtcactatgttagtgacaactcttagcctggttncagcacaactggccaggctccaggctccncatctatgctgcatccatcagggccatggcatcccaggcagacttcgagtggcaggtcggggtctggggacaggtaccttcactctacaccatcagcagactggacgcctagaagtatttgctagtcttattactgtcagctagtatggtcacgtaccagtaacgtttcggacgtagggaccaaagcgtaggagactacgaaacgtaacgtgtacggctagaccactatcg

SEQ ID NO: 376228 - DNA, 487 bp, Homo sapiens
  misc_feature: GZ8MTXP02GJ3I7.10.35.D02.1.454.CMB.2.raw
  modified_base (199)..(199): a, c, t, g, unknown or other
  modified_base (209)..(209): a, c, t, g, unknown or other
  modified_base (383)..(383): a, c, t, g, unknown or other
  modified_base (390)..(390): a, c, t, g, unknown or other
  modified_base (412)..(412): a, c, t, g, unknown or other
tcagcatagtagtgcacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctntcctgcagggccagtcactatgttagtgacaatacttagcctggttgcagcacaacctggccaggctcccaggctcctcatctatgctgcatccatcagggccactggcatcccaggcagattcagtgcagtggtctggggacagacttcactctcaccatcagcagactggancctgaantttgcagtctattactgtcagnacgtatgtcacgtccaagtactttggaccgtagggaccaagctaggacgactcaaagaactgcggctgcacatcg

SEQ ID NO: 376229 - DNA, 523 bp, Homo sapiens
  misc_feature: GZ8MTXP02IGX40.10.35.D02.1.454.CMB.2.raw
  modified_base (200)..(200): a, c, t, g, unknown or other
  modified_base (258)..(258): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttncagcacaaacctggccaggctccagctcctcatctatgctgcatccatcagggccactggcatcccaggcagacttcagtggcagtgggtctggggacagaccttcactctcacccatcagcagactggagcctagaacgtatttgctagtcttaagttactgtcagcagtatggtcacgtacccaaagtaacgtttggaccgtaggggaccaagtacgtaggacgtactacaaaacgtaacgtggtaggctagacacaacttcg

SEQ ID NO: 376230 - DNA, 500 bp, Homo sapiens
  misc_feature: GZ8MTXP02FSXON.10.35.D02.1.454.CMB.2.raw
  modified_base (200)..(200): a, c, t, g, unknown or other
  modified_base (209)..(209): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctntcctgcagggccagtcactatgttagtgacaactacttagcctggttgcagcacaaacctggccaggctcccaggctcctcatctatgctgcatccatcagggccatggcatcccaggcagacttcagtggcagtgggtctggggacaggtacttcactctcacatcagcagactgacgcctagaagtctttgctagtctattactgtcagcagtatggtcacgtccaagtacgtttcggacgtagggaccaaggcgtggacgactacaaagaacgtgcgactgacacatc

SEQ ID NO: 376231 - DNA, 586 bp, Homo sapiens
  misc_feature: GZ8MTXP02F7OXN.10.35.D02.1.454.CMB.2.raw
  modified_base (582)..(582): a, c, t, g, unknown or other
  modified_base (585)..(586): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtacaaagaacaccgtgtatctggaaatgagcagcctaggaaagcgatgacacaggactctattattgtaccactaagacgtcccaacgaagactggtagggaaagggactggcgtcggggcccaggggacgccccttgtccaccgtcctcctcacgccctcccaaccgaaacggggccccacgtccggtcccttcccccgtggcccgccctcgcctccaggacgccaccctccgagacgccacgacggccgggccccgtcggggccttcggccccgtgggtaccaaagggtaccttacctttccccacttacctatcgctggacgcgggctggccaaggcgcanagnn

SEQ ID NO: 376232 - DNA, 530 bp, Homo sapiens
  misc_feature: GZ8MTXP02GT77S.10.35.D02.1.454.CMB.2.raw
  modified_base (200)..(200): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcacaacctggccaggctccaggcctcctcatctatgctgcatccatcagggccacgtggcatccccaggccagacttcagtggcaggtgggtctggggacaggacttcactctcaccatcagcagactggagcctagaacgtatttcgactagttcttattactgtacagtcagtatcgtcacgtccaaagtacgtttcggaccgtaggggaccaaggcgtaggacgactacgaaaacgtaacgtggtacggctagctaccgatttccg

SEQ ID NO: 376233 - DNA, 537 bp, Homo sapiens
  misc_feature: GZ8MTXP02I2237.10.35.D02.1.454.CMB.2.raw
  modified_base (200)..(200): a, c, t, g, unknown or other
  modified_base (210)..(210): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctntcctgcagggccagtcactatgttagtgacaactacttagcctggttgcagcacaaacctggccaggctcccaggctcctcatctatgctgcatccatcagggccatggcatcccaggcagacttcagtggctaggtgggtctggggacaggtacttcactctcaccatcagcagactggacgcctgaagtagtttgctagttcttattacgttgtcagtacagtatgtctacgtcctaagtaacgtttggaccgtaggggaccaggcgttaggacgaacgtacgaaacgtaacgtcggtacggtacgtacgacctacgactttacg

SEQ ID NO: 376234 - DNA, 505 bp, Homo sapiens
  misc_feature: GZ8MTXP02FLE72.10.35.D02.1.454.CMB.2.raw
  modified_base (200)..(200): a, c, t, g, unknown or other
  modified_base (287)..(287): a, c, t, g, unknown or other
  modified_base (392)..(392): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcacaactggccaggctccaggctccncatctatgctgcatccatcagggccatggcactcccaggcagacttcagtggcaggtgggtctggggacaggtacttcacttctacaccatcagcagactggacncctagaagtatttgctagtctattactgtcagcagtatggtcacgtccaagtactttcggaccgagggacacgcgtaggacgactacaaaacgcgtagtcgctgacacgatcg

SEQ ID NO: 376235 - DNA, 603 bp, Homo sapiens
  misc_feature: GZ8MTXP02G8ZGY.10.35.D02.1.454.CMB.2.raw
  modified_base (200)..(200): a, c, t, g, unknown or other
  modified_base (208)..(208): a, c, t, g, unknown or other
  modified_base (257)..(257): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccacctntcctgcagggccagtcactatgttagtgactaactacttagcctggttncagcaacaaacctggccaggcctcccgaggtcctcctcatctatgtccttcatccatccgacgggccacgtggcactcccgaggcagtattccgagtcgcaggtcgggtctagggacagtaccttacgaccttcgacacctatacgagacgaacgtacgtaggacgtccgtagtaagttactttcgactacgttacttacgtttactgttaccgagtacgtagtacgtcggtactaaccggtacctaaaggttacgtttcgggaccgtaacggggacctaaggcgtaggaacgtacgtaacgaaacgtacgtaaggtacggactacggacctacctacgtcttacg

SEQ ID NO: 376236 - DNA, 543 bp, Homo sapiens
  misc_feature: GZ8MTXP02JHXXN.10.35.D02.1.454.CMB.2.raw
  modified_base (200)..(200): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaactacttagcctggttgcagcacaaacctggccaggctccaggctcctcatctatgctgcatccatcagggccacgtggcatccccgaggcagacttcagtgcaggtgggtctggggacagtacttcatctcaccatcagcagactggacgacccgaagtagtttgacgtagttactacttactcgttacagtactagtagtggtacgtacgtaccctaaagtaacgtttacggaccgtacggggaccaaagcgtaggagtactaacgaaacgaacgtgtcggacgtacgacacctatcttcg

SEQ ID NO: 376237 - DNA, 656 bp, Homo sapiens
  misc_feature: GZ8MTXP02FGE0L.10.35.D02.1.454.CMB.2.raw
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccataagagtccccaagaagactggtagggaagggactggcgtcgggggccaggggacgcccctttggccaccggttcctccctcgagcccctccaaccgaaacggggccccaacgttccggtcccttccccccgtcggcccgccccgttcgccctccgacgggacgccacccgtccggacgacgccacgacggcccgggcccgtcggggcctcggcccgttcgggtaccgaaacgggtacccttaacccttacccccgtaaaccttacccgttaaacttcggtccgttacgggaacggtccgggggaccgtcggggaccgaaaacggggcccgaccgaacgtacggcgcg

SEQ ID NO: 376238 - DNA, 534 bp, Homo sapiens
  misc_feature: GZ8MTXP02GVR8J.10.35.D02.1.454.CMB.2.raw
  modified_base (201)..(201): a, c, t, g, unknown or other
  modified_base (258)..(258): a, c, t, g, unknown or other
  modified_base (367)..(367): a, c, t, g, unknown or other
  modified_base (386)..(386): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaangccaccctctcctgcagggccagtcactatgttagtgacaactacttagcctggttncagcacaaacctggccaggctccaggctcctcatctatgctgcatccatcagggccatggcatcccaggcagacttcagtgcagtggtctggggacaggacttcactcncaccatcagcagactggancctagaacgtatttgctagtctattactgtcagcagtatcggtactacgtacccaaagtaactttcggaccgaaggggtaccaaaggtccgtaggacgtaactacgaaaacgtaacgtaggtacggactacgacctaccgtacttccg

SEQ ID NO: 376239 - DNA, 619 bp, Homo sapiens
  misc_feature: GZ8MTXP02I790M.10.35.D02.1.454.CMB.2.raw
  modified_base (280)..(280): a, c, t, g, unknown or other
  modified_base (475)..(475): a, c, t, g, unknown or other
  modified_base (618)..(619): a, c, t, g, unknown or other
tcagcatagtagtgcacgaccggtgctcgatttagcacacgatagttgggtttggggggtcccttagactctcctgttcagcctctgtattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctggaaatgagcagcctaggaaancgatgacacaggactctattattgtaccactaagacgtcccaacgaaagctggtagggaaagggactggcgtgggggcccaggggacgtccccgtttgtcccaccgtctccctcacgcccctccaaccgaacggggccccacgtccggttcccttcccccgtgggccctccccgtcggccctcccgacgggaccncccaccgtaccggacgaccgacacgcggcccgggcccgtcgggcctcggccgtacggtaccgaaacggtaccttaacccgttaccctaacttacctacgtcgcgtacggacggcggcgtcggacgacggccgacgacgtacgnn

SEQ ID NO: 376240 - DNA, 726 bp, Homo sapiens
  misc_feature: GZ8MTXP02J3VL9.10.35.D02.1.454.CMB.2.raw
  modified_base (725)..(725): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtggacaacagagtacgctggattacgtaaaagcagattcgccatctcaattgatgagtacaaagacacgtgtatctaggaaatgagcagcctaggaaagcgatgacacaggactctattattgtaccaataagacgtacccaacgaaagacgtggtaggggaaagggacgtggacggtcgggggaccccggaagggtccgtcccgtttcgcccgtacccgtcctccctaccgccgccctacccgaaccgaccggcccctaccggttcccgttccccgttcccccgtcggaccccgtcccgtcggaccctacccggacggaccgtacccgaaccccgtccggacgaccgacccgaacggtcccggccccggggttcccggtccgggccgttacccggccccggttaacgggtaacccggaaaaccggtaaccctttaccccgttaacccccgtaaaccttaaacgtaccggttggaacccgggacgggacccgggggttccgtaccgggggaaccgtaaaccgggcccggaaacgtacgacgcgcnc

SEQ ID NO: 376241 - DNA, 527 bp, Homo sapiens
  misc_feature: GZ8MTXP02JPNO8.10.35.D02.1.454.CMB.2.raw
  modified_base (200)..(200): a, c, t, g, unknown or other
  modified_base (288)..(288): a, c, t, g, unknown or other
  modified_base (395)..(395): a, c, t, g, unknown or other
  modified_base (405)..(405): a, c, t, g, unknown or other
  modified_base (434)..(434): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaactacttagcctggttgcagcacaacctggccaggctccaggctcctnatctatgctgcatccatcgagggccacgtggcactcccgaggcagacttcgagtggcaggtggtctggggacaggtaccttcactctcaccatcagcagactggacncctagaagtntttgctagttcttattactgtcagcagtntcggtcacgtacccaagtacgtttcggaccgtagggaccaaggcgtaggacgactacgaaacgtaacgtgtacggctacgaccacgtacttcg

SEQ ID NO: 376242 - DNA, 534 bp, Homo sapiens
  misc_feature: GZ8MTXP02FKXPH.10.35.D02.1.454.CMB.2.raw
  modified_base (200)..(200): a, c, t, g, unknown or other
  modified_base (258)..(258): a, c, t, g, unknown or other
  modified_base (375)..(375): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangcccaccctctcctgcagggccagtcactatgttagtgacaactacttagcctggttncagcacaactggccaggctcccaggcctcctcatctatgctgcatccatcgagggccagtggcactcccaggcagacttcgagtgcaggtgggtctggggacaggtacttcacttcncaccatcagcagactggacgcctagaagtatttagctagtctattactgtcagctagtagtggtactacgtacctaagtacgtttcggaccgtacgggtaccaacggcgtaggacgtaactacgaaaacgaacgtaggtacgcgtagaccacctatacg

SEQ ID NO: 376243 - DNA, 553 bp, Homo sapiens
  misc_feature: GZ8MTXP02FXJH7.10.35.D02.1.454.CMB.2.raw
  modified_base (202)..(202): a, c, t, g, unknown or other
  modified_base (259)..(259): a, c, t, g, unknown or other
  modified_base (397)..(397): a, c, t, g, unknown or other
  modified_base (408)..(408): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaaggggaaanagccaccctctcctgcagggccagtcactatgttagtgacaactactagcctggttncagcacaactggccaggctccaggctcctcatctatgctgcatccatcgaggccatggcactcccaggcagattcagtggcgtaggtggggtctggggacaggtacttccgactcgtacaccatcagcagactggacncctagaacgtntttagctagttctattacgtgtacagctagtatcgtacacgtacctaaagtacgtttacggaccgtaacggggaccaagtccgtaggaacgtaacgtaacgaaaacggtaacgtaggttacggacgtacgacctactactttacg

SEQ ID NO: 376244 - DNA, 649 bp, Homo sapiens
  misc_feature: GZ8MTXP02IY9M5.10.35.D02.1.454.CMB.2.raw
  modified_base (479)..(479): a, c, t, g, unknown or other
  modified_base (646)..(646): a, c, t, g, unknown or other
  modified_base (648)..(648): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctggaaatgagcagcctaggaaagcgatgacacaggactctaattattcgtaaccactaaagacgtacccaacgaaagactggtagggaaaggactggcgtcggggacccaggggacgtcccgttgtccacccgtctccctcacgccctacccaccaaaccgggcccaacgtccggttcccttccccccgtcggcccgcccccgttgccctcccgagggaccnccacccgtccggacgacggccaaccgacggcccgggccccgttgggggccttcggccccgttgggtaccgaaaacgggtcccttaaaccgtttcccccaaactaccttaacgtccggacttcggacggtccgggtctaacggggccgaaagggccgactaacgtcgngng

SEQ ID NO: 376245 - DNA, 518 bp, Homo sapiens
  misc_feature: GZ8MTXP02FNBP3.10.35.D02.1.454.CMB.2.raw
  modified_base (200)..(200): a, c, t, g, unknown or other
  modified_base (288)..(288): a, c, t, g, unknown or other
  modified_base (374)..(374): a, c, t, g, unknown or other
  modified_base (403)..(403): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaactacttagcctggttgcagcacaacctggccaggctcccaggctccnatctatgctgcatccatcagggccagtggccatccccgaggccagacttcgagtggctaggtgggtctggggacagacttcactcncaccatcagcagactggagcctagaagtntttagctagtcttattactgtcagctagtagtggtctacgtaccaagtacgtttggaccgtaggggaccagcgtaggacgactacgaaaacgaacgtaggcgctgctaccattcg

SEQ ID NO: 376246 - DNA, 511 bp, Homo sapiens
  misc_feature: GZ8MTXP02G4TPY.10.35.D02.1.454.CMB.2.raw
  modified_base (200)..(200): a, c, t, g, unknown or other
  modified_base (384)..(384): a, c, t, g, unknown or other
  modified_base (394)..(394): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcacaactggccaggctcccaggctcctcatctatgctgcatccatcagggccactggcatcccaggcagacttcagtgcaggtggtctgggacagacttcactctcacatcagcagactggancctagaagtntttgctagtctattactgtacagctagtatcggtcacgtaccaagtacgtttcggaccgtaggggaccaagcgtaggacgtactacgaaacgaacgtgtcggactgacaccgtatcg

SEQ ID NO: 376247 - DNA, 606 bp, Homo sapiens
  misc_feature: GZ8MTXP02H26ES.10.35.D02.1.454.CMB.2.raw
  modified_base (200)..(200): a, c, t, g, unknown or other
  modified_base (391)..(391): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcaacaaacctggccaggcctcccaggcctcctcatctatgctgcatcccatcgagggccacgtcggcactccccgaggcagacttcgagtggactaggtgggtctggggacagtaccttcactcacaccntcagcagacgtgacgtcctagagtatttgactagttctattacgtgtacagtaccgtagttacgtcggttaccgaaccgttacccgtaaagttaccgttttacgggaccggtaacgggggtaaacccaaaggtccggtaaaggtaacgtaaacgttaaccgaaaaccggttaacgtacgggttaacggcgttcggaacctaacccgttattcccg

SEQ ID NO: 376248 - DNA, 541 bp, Homo sapiens
  misc_feature: GZ8MTXP02GX007.10.35.D02.1.454.CMB.2.raw
  modified_base (540)..(541): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaaagagtcccagaagactgtgggaaagggactgcgtggggccagggagcccttgcaccgtctcctcagccctccaccaagggcccatcgtcctcccctggccgccctgcctcacggacgcacctccgagacgcacgagccggccctggggctcgccgtcggtaccaacggtactaaccttccccaactactactcgcctgacgcgggcgtggcgaaaggcgacagacgnn

SEQ ID NO: 376249 - DNA, 637 bp, Homo sapiens
  misc_feature: GZ8MTXP02HHG5S.10.35.D02.1.454.CMB.2.raw
  modified_base (201)..(201): a, c, t, g, unknown or other
  modified_base (239)..(239): a, c, t, g, unknown or other
  modified_base (260)..(260): a, c, t, g, unknown or other
  modified_base (434)..(434): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaancgccaccctctcctgcagggccagtcactatgttagtnacaactacttagccttggttncagcaacaaacctggccaggcctcccgaggcctcctcatctatgctgcatccatcgacgggccacgtcgcactcccgaggcagtaccttcgaggtggctaggtcggggtctgggggacaggtaccttccacttctaccacctatccagcaggacgtggacgtcctagtaagttntttcgactagttcttaattacgttgtacagtactaagttacgtcggtacctaaccggttacccgtaaaaggttaccgtttacggggaaccggtaacgggggtaaccctaaagggtaccggttaagggaacgtaaccgttaaaccgaaaaccggttaacgttacgggtacggtaccttacggaccctaaccgttacgtttcccg

SEQ ID NO: 376250 - DNA, 584 bp, Homo sapiens
  misc_feature: GZ8MTXP02G2NI4.10.35.D02.1.454.CMB.2.raw
  modified_base (201)..(201): a, c, t, g, unknown or other
  modified_base (286)..(286): a, c, t, g, unknown or other
  modified_base (293)..(293): a, c, t, g, unknown or other
  modified_base (400)..(400): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaanagccaccctctcctgcagggccagtcactatgttagtgacaactcttagcctggttgcagcacaactggccaggctccaggctcncatctangctgcatccatcagggccagtggcatcccaggcagtacttcgagtggactaggtcgggtctggggacaggtacttcgactcacacctatcacgtcagaccgtggacnccgtagaacgttatttcgactagtcttaagttctgtacagtctagttatcggtacaaccgttaccgtaagttaaccgtttcggaaccgtacgggggtaacctaacggtacgtacgggaacgtaacgtaaccgaaaacggtaacgttcgggtacggtacgttcgaccgtaaccgtagtttcccgg

SEQ ID NO: 376251 - DNA, 586 bp, Homo sapiens
  misc_feature: GZ8MTXP02G1HEC.10.35.D02.1.454.CMB.2.raw
  modified_base (585)..(586): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctgattcgtaaaaggcagattcgccatctcaattgatgagtacaaagaacaccgtgtatctggaaatgagcagcctaggaaagcgatgacacagactctattattgtaccactaaagacgtacccaagaagactggtaggggaaaggactggcgtcggggcccaggggacgtcccgttgtccacccgtctccctcacgccctccaaccgaacgggcccctaagtcccggtcccttccccccgtcggcccgtccccgtcgccctccgacggacgccacccgtccgacgagccacgacgccgggccctgggcctcgccgtcggtacaacggtactaccttacccactactactcgctcgacgtcggcgtggacgaacggcgacagtacgnn

SEQ ID NO: 376252 - DNA, 504 bp, Homo sapiens
  misc_feature: GZ8MTXP02FLSRH.10.35.D02.1.454.CMB.2.raw
  modified_base (200)..(200): a, c, t, g, unknown or other
  modified_base (257)..(257): a, c, t, g, unknown or other
  modified_base (363)..(363): a, c, t, g, unknown or other
  modified_base (368)..(368): a, c, t, g, unknown or other
  modified_base (422)..(422): a, c, t, g, unknown or other
  modified_base (477)..(477): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaactacttagcctggttncagcacaacctggccaggctcccaggctcctcatcatgctgcatccatcagggccactggcatcccaggcagacttcagtgcagtggggtctggggacaggacttnattcncaccatcagcagactggagcctagaagtatttgctagtcttagttactgtcagntacgtgtggtacacgtcccaagtactttcggactaggggaccagacgtggagacncgaaagaacgtgtcgctgacacgatcg

SEQ ID NO: 376253 - DNA, 527 bp, Homo sapiens
  misc_feature: GZ8MTXP02IQHQF.10.35.D02.1.454.CMB.2.raw
  modified_base (201)..(201): a, c, t, g, unknown or other
  modified_base (237)..(237): a, c, t, g, unknown or other
  modified_base (258)..(258): a, c, t, g, unknown or other
  modified_base (288)..(288): a, c, t, g, unknown or other
  modified_base (395)..(395): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaangccaccctctcctgcagggccagtcactatgttagngacaactacttagcctggttncagcacaaacctgccaggctccagctcctnatctatgctgcatccatcgagggccactggcactcccaggcagacttcgagtggctaggtgggtctggggacaggtacttcactctacaccatcagcagactggacncctagaacgtatttgactagttcttagttacttgactagctagtatggtaccacgtaccaagtacgttggaccgagggaccaagcgtaggactacgtaacgaaacgtaacgtgtacggctgaccacgtatcg

SEQ ID NO: 376254 - DNA, 581 bp, Homo sapiens
  misc_feature: GZ8MTXP02HV7X0.10.35.D02.1.454.CMB.2.raw
  modified_base (304)..(304): a, c, t, g, unknown or other
  modified_base (382)..(382): a, c, t, g, unknown or other
  modified_base (439)..(439): a, c, t, g, unknown or other
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttgggttaaggccggggggtcccttagactctcctgttcagcctctggattcagtgtcactaacgcctggatgagctgggtccnccagtccccaggggagggctggaggtgggttggcctttagtagaagcagacctgatgggtagggacaacagagtacgntggattacggtaaaagcagattcgaccatctacattgatgagtacaaaagacacgtntatctaggaaatgagcaggcctagaaagcgatgacagaaggacttactatttatacgtaacctaaacgtaaacgaccgtacccaaacgaaacgtaccgtaagggtacgggggaaaacgggtaccgtggtaccggtacggggg

SEQ ID NO: 376255 - DNA, 527 bp, Homo sapiens
  misc_feature: GZ8MTXP02G5GJ5.10.35.D02.1.454.CMB.2.raw
  modified_base (200)..(200): a, c, t, g, unknown or other
  modified_base (209)..(209): a, c, t, g, unknown or other
  modified_base (405)..(405): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctntcctgcagggccagtcactatgttagtgactaactacttagcctggttgcagcacaacctggccaggctccaggctcctcatctatgctgcatccatcgagggccacgtggcactcccaggcagacttcagtggctaggtcgggtctggggactaggacttcgactctcacatcagcagactgagccagtaacgtntttgctagtctattactgtcagctagtatgtcacgtacctaagtacgtttggaccgtagggacaacggcgtaggactaacgtacgtaaacgaacgttaggcggtactacggacacctagtcg

SEQ ID NO: 376256 - DNA, 590 bp, Homo sapiens
  misc_feature: GZ8MTXP02IP5UI.10.35.D02.1.454.CMB.2.raw
  modified_base (201)..(201): a, c, t, g, unknown or other
  modified_base (398)..(398): a, c, t, g, unknown or other
  modified_base (407)..(407): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaanagccaccctctcctgcagggccagtcactatgttagtgacaactacttagccttggttgcagcacaaacctggcccaggcctccaggctcctcatctatgctgcatccatcacgggccacgtggcactcccaggcagtactcagtgctaggtggtctggggacagtaccttcactcactaccatcagcagacgtganctagaagtntttgactattctaattacgtgtacagtactagtacgtacggtacaaccgtaccgtaaagtaccgtttacgggacccggtaacgggggtaaacctaacggtacggttacggaacgtaaacgttaaccgaaaaccggtaacgttacggtacggtaccttaacggaccctaaccgttactttaccg

SEQ ID NO: 376257 - DNA, 560 bp, Homo sapiens
  misc_feature: GZ8MTXP02GR3JL.10.35.D02.1.454.CMB.2.raw
  modified_base (200)..(200): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcacaactggccaggctccagctcctcatctatgctgcatccatcagggccactggcatcccaggcagacttcagtggcaggtggtctggggacagaccttcactctacacatcagcagactggagccctagaagtatttgactagttctattactgtcagcagttatcggtacacgtacccaaagtacgtttacggacccgtagggggaccctaaaggtccgtagggaacgtaacgttaaccgaaaaccgggtaacttacgggtacgggaccttacggacctaacccgtaagtttcccg

SEQ ID NO: 376258 - DNA, 632 bp, Homo sapiens
  misc_feature: GZ8MTXP02HFKFT.10.35.D02.1.454.CMB.2.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgctaattttaaaaggtgtccagtgtgacgtgcagttggtggagtcgtgggggaggtcgttgggttaaggccggggggtcccttagactctcctgttcagcctctggattcagtgtcactaacgcctggatgagcgtcgggtccgccacggtcccccgaggggaacggggctgggaggtggggttcggcctttattaggaagcaagacctggagtgggtagggacaaacgaggagtacgcgtgggaattacggtaaaaggcaagattcgcctatctacaattgatgatacaaagacaccgtatatacgaggaaatgagacaggccgtaggaaacgcgaagtacgacacgaggtacctacgttaattacgttacgtaaacctaacgtaaacgtaaccgtaccccgaaacggaaagtaccgttaggggtacgggggaaacggtaccgttacggggaccggtaccggggg

SEQ ID NO: 376259 - DNA, 701 bp, Homo sapiens
  misc_feature: GZ8MTXP02HYLZ8.10.35.D02.1.454.CMB.2.raw
  modified_base (198)..(198): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgctccaggggaangccacctctcctgcagggccagtcactatgttagtgacaactacttagcctggttgcagcacaactggccaggctccaggctcctcatctatgctgcatccatcgagggccacgtggccatcccaggcagtacttcgagtggctaggtcggggtctgggggacacggtacctttccaacgttcctaccaaaccctactaccgaacgacacggacgtagggtacgtacccgttaaggtaaacgttaagttttcggacgttaaacggtttccgttaaattttaccgttacgttaccgtaacggtaccgttaaggttacgttacgggttaacccgtaaccggttaaccccgttaaaagggttaacccgtttttacggggaacccggtaaacgggggtaaaccctaaacgggtccggttaaacgggaaacggtaacgttaaaccgtaaaaccggtaaccgttagggttaacgggtaccgttacgaacccgtaaccttaacgtttccg

SEQ ID NO: 376260 - DNA, 621 bp, Homo sapiens
  misc_feature: GZ8MTXP02JY22H.10.35.D02.1.454.CMB.2.raw
  modified_base (283)..(283): a, c, t, g, unknown or other
  modified_base (620)..(620): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtacaaagaacaccgtgtatctaggaaatgagcagcctaggaaancgatgacacaggactctattattcgtaccataagacgtacccaacggaagacgtggaggggaaagggctggcgtcgggggaccaggggacgcccttggacctaccgtctcctcacgcctcccaaccgacgggcccacgtccgtcccttcccccgtggccctcccgtcgcctcccgacggaccgccaccgtccggagacgaccacgacggtcccgggcccgtcgggccgtcggcccgttcggtaccgtaacgggtacccttaccgtttaccccgacttaaccgtacgtccgtcttcgggacgggccggcggtcgggaccaacggggcgacacgacgcng

SEQ ID NO: 376261 - DNA, 581 bp, Homo sapiens
  misc_feature: GZ8MTXP02G4ORH.10.35.D02.1.454.CMB.2.raw
  modified_base (200)..(200): a, c, t, g, unknown or other
  modified_base (210)..(210): a, c, t, g, unknown or other
  modified_base (360)..(360): a, c, t, g, unknown or other
  modified_base (414)..(414): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctntcctgcagggccagtcactatgttagtgacaactacttagcctggttgcagcacaacctggccaggctcccaggctcctcatctatgctgcatccatcgagggcccagtggccactccccgaggcagtcttcgagtggcaggtgggttcnggggactagaccttcgactctcacctatcagactagactggagcctagaagttntttagctagttcttattacgtgtaccgagtacgtagtacgttcggtactaccggtacctaaaggttaacgttttcgggaaccgtaacgggggtacctaacgggtacgtagggtacgacgttaacgaaacggtaacgtggtacggtactacgacctaccgtactttcg

SEQ ID NO: 376262 - DNA, 571 bp, Homo sapiens
  misc_feature: GZ8MTXP02F7JV2.10.35.D02.1.454.CMB.2.raw
  modified_base (201)..(201): a, c, t, g, unknown or other
  modified_base (413)..(413): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaangccaccctctcctgcagggccagtcactatgttagtgacaactcttagcctggttgcagcaacaaacctggccaggctccaggctcctcatctatgctgcatccatcgaggccacgtggcactcccaggccagtacttcgaggtggcaggtcgggtctggggacagtacttcacttctcaccagtcagcaagacgtggacgcctagaacgtntttacgctagttacttattacgttgtctagtactagttacgtgtacctaaccgtaccgtaaagttacgtttacggaccgtaacggggtaaccaacggtacgtaggacgtaactaacgaaaacgtaacgtaggtacggactacgtacacctacgttccg

SEQ ID NO: 376263 - DNA, 555 bp, Homo sapiens
  misc_feature: GZ8MTXP02J11NY.10.35.D02.1.454.CMB.2.raw
  modified_base (200)..(200): a, c, t, g, unknown or other
  modified_base (255)..(255): a, c, t, g, unknown or other
  modified_base (283)..(283): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccacctctcctgcagggccagtcactatgttatgacaactacttagcctggttncagcacaaacctggccaggctccaggcncctcatctatgctgcatccatcaggccatgcatcccgaggcagacttcgagtgcaggtggtctggggacagtacttcgactctacaccatcagcagactgagcctagaagtattttgctagtcttattactgtacagctagtagtaggttcacggtaccctaaagtaaaccgttttcggaccgaacgggggtaccaacggtaccgtagggaacgacgttaacgaaaaccggtaacgtacggttacgggcttacggaccaaaccgtacttccg

SEQ ID NO: 376264 - DNA, 555 bp, Homo sapiens
  misc_feature: GZ8MTXP02FO159.10.35.D02.1.454.CMB.2.raw
  modified_base (201)..(201): a, c, t, g, unknown or other
  modified_base (211)..(211): a, c, t, g, unknown or other
  modified_base (359)..(359): a, c, t, g, unknown or other
  modified_base (409)..(409): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaanagccaccctntcctgcagggccagtcactatgttagtgacaactacttagcctggttgcagcacaactggccaggctccaggcctcctcatcatgctgcatccatcgaggccagtggcactccgagtcagtactcgagtgctaggtgggtctgggacnggacttcgactctcacctatcacgcacgacgtggacgccgtagaaagttntttagctaggttactattacgtgtacagactagtagtcgtacgtaccgtaccgtaagtacgtttacggaccgacggggacctagtccggtaggtacaacgtaccgaaaacgtaagtcggacgtcgtacgacctaacctgtttaccg

SEQ ID NO: 376265 - DNA, 586 bp, Homo sapiens
  misc_feature: GZ8MTXP02JLCLZ.10.35.D02.1.454.CMB.2.raw
  modified_base (282)..(282): a, c, t, g, unknown or other
  modified_base (299)..(299): a, c, t, g, unknown or other
  modified_base (432)..(432): a, c, t, g, unknown or other
  modified_base (438)..(438): a, c, t, g, unknown or other
  modified_base (585)..(585): a, c, t, g, unknown or other
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtacaaagaaccacgtgtatctggaaatgagcagcctaggaaancgaatgacacaggactntattattcgaccactaagcgtcccaagaagactggtagggaaggactggctcggggaccaggggactccccgttgtcaccgtctcctcacgtccctacacccgaagggccccagtcccggtccttccccccgnggcccncccgtgcctacgacgcacctacgccgagacgctacgcggccggccgtggcctcggccgtaggtaccgaacgtacctacccttacccgacttaccgtagtcgtactacgggacggcggtcgaaggacggacggacgacgacgtacgang

SEQ ID NO: 376266 - DNA, 640 bp, Homo sapiens
  misc_feature: GZ8MTXP02F2BCN.10.35.D02.1.454.CMB.2.raw
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagacacgtgtatctggaaatgagcagcctaggaaagcgatgacacaggactctattattgtaccactaagacgtcccaacgaagactggtagggaaggactgcgtcggggccaggggacgcccttgccaccgttcctcctcacgccctccaccgaacggggcccacgtccggtcccttcccccgtggcccgccctcgcctccgacgggacgccacccgtccggaacgacgccgaccgacggcccgggccccgttcgggggccttcggcccgttacgggtaccgaaacgggtacccttaacccgttacccccaaccgttacctaaacgttcgaccgttacggaacgggccggggttccgtcggggaccgaaacggggccggtaccaacgtaacggcgcg

SEQ ID NO: 376267 - DNA, 538 bp, Homo sapiens
  misc_feature: GZ8MTXP02G2G6J.10.35.D02.1.454.CMB.2.raw
  modified_base (201)..(201): a, c, t, g, unknown or other
  modified_base (258)..(258): a, c, t, g, unknown or other
  modified_base (285)..(285): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaangccaccctctcctgcagggccagtcactatgttagtgacaacttactagcctggttncagcacaactggcaggctccagctccnatctatgctgcatccatcgacggccacgtggcactcccgaggcagtcttcgagtgctaggtcgggtctggggacaggtaccttcgactctaccactatcagcaggactggagtccgtagtaagtatttgacttagtcttattacgtgtacgagtactagttcgtaggtacctacgtaccaagttaacgtttcggaccgagggaccaggcgtaggacgactacaaacgcgtaggcggtactgacctactattcg

SEQ ID NO: 376268 - DNA, 629 bp, Homo sapiens
  misc_feature: GZ8MTXP02FRVWW.10.35.D02.1.454.CMB.2.raw
  modified_base (278)..(278): a, c, t, g, unknown or other
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggagtcgttgggttaacggccggggggtcccttagactctcctgtcagcctctggattcagtntcactaacgcctggatgagcgtgggtccgccacggtccccgaggggaagggctgggagtggggttcgctttagtagaagcagacctgatcggtaggacaacgaggagtacgctggacttacggaaaaggcaagtattccgacctatctacaattgatagaacgtacaaaacggaactacgtagtactacgtaggaaactgagcgaacgaccgtaaggaaacgcgtaacgtacgaacgaacgacgtaactacttaaacgttattacgtaaacctaaacgttaaacgaccgttaccccgaaagtaaacgtacgtaagggtacggggaaacgggtacgtacggcggtacggggg

SEQ ID NO: 376269 - DNA, 570 bp, Homo sapiens
  misc_feature: GZ8MTXP02HFD0U.10.35.D02.1.454.CMB.2.raw
  modified_base (201)..(201): a, c, t, g, unknown or other
  modified_base (237)..(237): a, c, t, g, unknown or other
  modified_base (361)..(361): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaangccaccatctcctgcagggccagtcactatgttagngaacaactacttagcctggttgcagcacaaacctggccaggctccaggctcctcatctatcgctgcatccatcgaggccacgtgcatcccaggcagatcagtgcaggtggcgtggacagacttnacgtctacacatcagcagacgtcggagcctagaacgtatttgactagttactatttacgtgtacagtactaagttacgtcggtactaccgtaccgtaaagtaaccgttttacggacccgtaagggggtaaccctaaaggccgttagggaacgtaacgttaacggaaaaccgtaacgtaaggtcggtaccgtacggacgtaaccgttacg

SEQ ID NO: 376270 - DNA, 549 bp, Homo sapiens
  misc_feature: GZ8MTXP02JLSIB.10.35.D02.1.454.CMB.2.raw
  modified_base (200)..(200): a, c, t, g, unknown or other
  modified_base (286)..(286): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcacaactggcagctccaggctcctnatcatgctgcatccatcagggccatggcactccaggcagacttcagtgcaggtgggtctggggaccaggaccttcgaccttcgtacacccatccagtaccagaccgtggacgtccgtagaacgtatttgctagttcttagttactgtacagtctagtatcggtactacggtacccaagttactttcgggaccgtaggggaccaacggtcgtaggactacgtacaaacggtaacgtcggtacgcgttagactaccgtattaccg

SEQ ID NO: 376271 - DNA, 539 bp, Homo sapiens
  misc_feature: GZ8MTXP02HJBBS.10.35.D02.1.454.CMB.2.raw
  modified_base (201)..(201): a, c, t, g, unknown or other
  modified_base (259)..(259): a, c, t, g, unknown or other
  modified_base (412)..(412): a, c, t, g, unknown or other
  modified_base (421)..(421): a, c, t, g, unknown or other
  modified_base (447)..(447): a, c, t, g, unknown or other
  modified_base (525)..(525): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaangccaccctctcctgcagggccagtcactatgttagtgactaactacttagcctggttncagcaacaaaccgtggccaggcctcccgaggcctcctcatctatgctgcatccatcgaggccagtcggcactcccgaggcagacttcgaggtcggctaggtcggggtctgggggactaggtaccttcgaactctacacatcagcagactgacncctagaatnttgctagtcttatctgcagactagtntcggtacctacgtacctaaggtacttggacgtagggaccaggtcgtaggactactaacgaaacgaagtgtacggctanaccaccttattccg

SEQ ID NO: 376272 - DNA, 521 bp, Homo sapiens
  misc_feature: GZ8MTXP02FGSEL.10.35.D02.1.454.CMB.2.raw
  modified_base (200)..(200): a, c, t, g, unknown or other
  modified_base (236)..(236): a, c, t, g, unknown or other
  modified_base (257)..(257): a, c, t, g, unknown or other
  modified_base (367)..(367): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagngacaactacttagcctggttncagcacaaactggccaggctcccaggctcctcatctatgctgcatccatcagggccatggcatcccaggcagacttcagtgcaggtgggtctggggacagacttcactcncaccatcagcagactggacgcccgaaagtattttgctagtctattactgtcagcagtatggtcacgtcccaagtaacgtttcggaccgacggggtaccaaggttaggagacgtacgaaaacgaacgtagtcgctcgactaccgactctcgttac

SEQ ID NO: 376273 - DNA, 568 bp, Homo sapiens
  misc_feature: GZ8MTXP02H7ZZ6.10.35.D02.1.454.CMB.2.raw
  modified_base (312)..(312): a, c, t, g, unknown or other
  modified_base (369)..(369): a, c, t, g, unknown or other
  modified_base (418)..(418): a, c, t, g, unknown or other
  modified_base (447)..(447): a, c, t, g, unknown or other
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgctaatttttaaaaggtgtccagtgtgacgtgcaggttggtggagtcgtggggggaggtcgttgggttaaggccgggggggtccttagactctcctgttcagtcctctggattcagtgtcactaacgcctggatgagctgggtccnccagtcccccgaggggagggctggaggtgggtggccttagtagagcagcctgatggnggacaacaggagtacgctggattagtaaaaggcagacttcgaccactcncaaattgatgagtacaaaagaacaccgtntaatctaggaaaatggagcagccgtaggaaagcgagtagacaagaggactactattattacgtaaccactaaacgacgtcccaagaagaccgtaggacgggaaggacctaggacgtcgggg

SEQ ID NO: 376274 - DNA, 659 bp, Homo sapiens
  misc_feature: GZ8MTXP02GV48V.10.35.D02.1.454.CMB.2.raw
  modified_base (327)..(327): a, c, t, g, unknown or other
  modified_base (573)..(573): a, c, t, g, unknown or other
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggtattttccttgctgactaaattttaaaaggtgtccagtgtgacgtgctaggttggtggaggtcgtggggggaggtcgttagggttaacggcccgggggggttcccttaggactcctcctgttcagcctcgtggacttcagtgtcactaacgcctggatgagcgtcgggtcccnccacgtcccccgagggggaacggggcgtgggaggttggggtaggtcctttagttaacggaagcgaagacctggatggggtaggaacaagaggaagtacgcgtgggaattacggtaaaaggcctaagtattccgacctatctaactaattgatagactaacaaaagtaacgaccgtatactagtagaaatcgaagcaaggaccgtaaggaaacgacgagtagaaccaagtacgacttactaactttnttactaaacctacgaaagtaccgtaacccgaaagaaacgtacgtaacgggtaaggggaacggtacgtacgggacgtaacccggggg

SEQ ID NO: 376275 - DNA, 777 bp, Homo sapiens
  misc_feature: GZ8MTXP02H2Z2D.10.35.D02.1.454.CMB.2.raw
  modified_base (200)..(200): a, c, t, g, unknown or other
  modified_base (238)..(238): a, c, t, g, unknown or other
  modified_base (260)..(260): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgctccgaggggaaancgccaccctctcctgcagggccagtccatagtgttagngaactaatcttagccttggtcnagcaacaacctggccaggcctccgagcctccacatctatgctgctactccagtccgacggtccaacgtcggacctacgtacccccgaggacctacgtaccttcggacggttcggaccgtaggggtcgggttaccgtgggggaacctaacggttacccttacgtacccgtttaccaccgtaaacccgtacgtaccgaaccggtaccgaacggtacccgtaacggggtaccgttacccggtaaggtaaacgtttacgttttacggacttaacggtttacctttaaacgtttaccgtacggttacccgtaagggtacccttaagttaacggttccggttacccgtaaacccggtttaaccccggtaaacggtttaacccggttttaccggggaacccgggtaaaccggggttaaaccccgaaacggttaccggtaacgggtaactaaaccgttaaaccggaaaaccggtaacggttacggtaacgggtaccttaccggaacccgtaccttaacgttcccg

SEQ ID NO: 376276 - DNA, 582 bp, Homo sapiens
  misc_feature: GZ8MTXP02JPZEP.10.35.D02.1.454.CMB.2.raw
  modified_base (201)..(201): a, c, t, g, unknown or other
  modified_base (258)..(258): a, c, t, g, unknown or other
  modified_base (367)..(367): a, c, t, g, unknown or other
  modified_base (399)..(399): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaangccaccctctcctgcagggccagtcactatgttagtgacaactacttagcctggttncagcaacaacctggaccaggcctccgaggcctcctcatctatgctgcatccagtcgacgggccagtggacactcccgaggcagacttcgagtgcaggtggctggggacngtacttcactcacacatcagcagacgtggacnccgtagtaacgttatttcgacttaagtctttagttaccgtgtacgacgtataagttacgtcggtacctaaccggttacctaaaggttcgtttacgggaccggtaggggaacctaaggcgtaggtaacaaccgttaacgaaaacggtaacgttggtaccggacttacgacctaaccggttatcg

SEQ ID NO: 376277 - DNA, 596 bp, Homo sapiens
  misc_feature: GZ8MTXP02IH874.10.35.D02.1.454.CMB.2.raw
  modified_base (200)..(200): a, c, t, g, unknown or other
  modified_base (261)..(261): a, c, t, g, unknown or other
  modified_base (408)..(408): a, c, t, g, unknown or other
  modified_base (418)..(418): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaanagccaccctctcctgcagggccagtcactatgttagtgaacaacttacttagccttggttncagcacaaacctggccaggcctcccaggcctcctcatctatgctgcatccatcgagggccacgtggaccactcccgaggcagtacttcgagtggcaggtgggtctggggacagtccttacacttcacaccatcagcagacgtggacnctagaagttntttcgactagttacttattacgttagcaagtactagttacgtcggtactaaccgttaaccgtaaagtttaacgtttacgggacccggtaaacgggggacccaaacggtcggtaagggaacgtaacgttaacgaaaacggtaacgttggtacggactacggacctaacgtatttacccg

SEQ ID NO: 376278 - DNA, 671 bp, Homo sapiens
  misc_feature: GZ8MTXP02HMYPJ.10.35.D02.1.454.CMB.2.raw
tcagcatagtagtgcacgaccggtgctcgatttagcacacgatagttgggtttggggctgggagaggagcccccagccctgggattcccaagtgtcttcattcagtgatcaggactgaacacagaggactcaccatggagtttgggctgaggtggattttccttgctgctaattttaaaaggtgtccagtgtgacgtgcagttggtggagtcgtgggggaggtcgttgggttaaggcccggggggtccttagactctcctgttcagcctctggattcagtgtcactaacgcctggatgagcgtcgggtcccgccgacggtcccccgaggggaacgggcgtgggaggttggggttcggacctttagttaaggaagcgaagaccgtgagtcgggtagggacaacgagacgtacgcgtggaattacggaaagcaagtacttcgcctatctactaagttgatagagtacgaaaaaagccgtaaccgtagtaacttacggtaggtaaaatggaagacgacgtaccgtaagggaaacgtacggatacggaactaaccgtaggaccttacttatttaacgttaccgtaaaccgtaacgtaaacgcccgtaaacccaacggaaacgtacgtaggggtaaacgggggttaaacggaccgtaggtaccgggtaaccggggg

SEQ ID NO: 376279 - DNA, 526 bp, Homo sapiens
  misc_feature: GZ8MTXP02I60L1.10.35.D02.1.454.CMB.2.raw
  modified_base (201)..(201): a, c, t, g, unknown or other
  modified_base (211)..(211): a, c, t, g, unknown or other
  modified_base (258)..(258): a, c, t, g, unknown or other
  modified_base (288)..(288): a, c, t, g, unknown or other
  modified_base (295)..(295): a, c, t, g, unknown or other
  modified_base (378)..(378): a, c, t, g, unknown or other
  modified_base (402)..(402): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaanagccaccctntcctgcagggccagtcactatgttagtgacaactcttagcctggttncagcacaaacctggccaggctccaggctcncatctangctgcatccatcgaggccactggcactcccgaggcagacttcgagtggcaggtggtctggggactaggactttcactcacacntcagcagctggagtccagaacgtntttcgactagttcttaattacgtgtacaggtacctagttagtcggtactacgtcccaaagttacgtttgaccgtaggggacaacggcgtaggatacacgaaacgtaactgacgtcagcacagtc

SEQ ID NO: 376280 - DNA, 578 bp, Homo sapiens
  misc_feature: GZ8MTXP02FWBYR.10.35.D02.1.454.CMB.2.raw
  modified_base (576)..(577): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtacaaagaacaccgtgtatctaggaaatgagcagcctaggaaagcgatgacacaggactctattattgtaccactaagacgtcccaacgaaagactggtaggggaagggactggcgtcggggccaggggacgtccttgtccaccgtctcctcacgccctccaccgaacgggcccagtccggtcccttcccccgtggccgccctcgcctccgacggcgaccaccgtaccgagacgccacgacgccgggccctgggcctcgccgtaggcaaacggacctacctacccactactactcgcgtcgacggcgggcgtcggacgaaacggcgacgagtacgnng

SEQ ID NO: 376281 - DNA, 753 bp, Homo sapiens
  misc_feature: GZ8MTXP02JM82J.10.35.D02.1.454.CMB.2.raw
  modified_base (199)..(199): a, c, t, g, unknown or other
  modified_base (291)..(291): a, c, t, g, unknown or other
  modified_base (308)..(308): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgctccgaggggaanacgccaccctctcctgcagggccagtcactatgttagtgactaactacttagcctggttgcagcaacaacgtggccaggcctccagcctccnatctatcgctcgctacnccatccgacgggccctacgtcggaccacgtaccccgagggactacggtacgttccgaggtcgacggtaggggttacggggttaccgtacggggaacctacggtacccgtttacccaccgttcccgaaccctacgtaacgttacgaaccggtacacggtacccgttaggggaaccgtccgtaaagttaacggttacgtttacggacgttacggtttactttaacgtttaaccggttcgtaaccgtacggttaacgtaaccggtttaacggtttcgggtaacccgttaacccgggttaaacccgttaaaccggtttaaccggggtttacccgggaaaccgggtaaccgggggttaaccaaaacgggtccgtaaggggtaacgtaaaacggtaacgtaaaccgtaacggttaggaccggtacttaccggacctaaaccgtctttcccg

SEQ ID NO: 376282 - DNA, 662 bp, Homo sapiens
  misc_feature: GZ8MTXP02G7ZPI.10.35.D02.1.454.CMB.2.raw
  modified_base (200)..(200): a, c, t, g, unknown or other
  modified_base (363)..(363): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgctccgaggggaaancgccaccctctcctgcagggccagtcactatgttagtgacaactacttagcctggttgcagcacaacgtgaccaggcctcccaggcctacctcatctatgctgctactccaatcgacgggtccacgtcggacactcccgaggctagtaccttcgagtcggacngggttcggttacgtgggggacctaaaggtaccctttacacctctaccgaaccctatccgaagcaacgtcgtaggactccgtagaacgtttacttcgacgttagttaccttatttacgtagttacgaaccgggtataaacgggtttactacggttacccgaaaccgttacccgtaaaaagggttccgttttacccggggacggtaaccgggggaaaccttaacggacgtaacggggtaactaaaccgtaaccggaaaacgtaaccgtggtaaccggtctaacgccctaactacgttcccg

SEQ ID NO: 376283 - DNA, 611 bp, Homo sapiens
  misc_feature: GZ8MTXP02ISCOJ.10.35.D02.1.454.CMB.2.raw
  modified_base (298)..(298): a, c, t, g, unknown or other
  modified_base (436)..(436): a, c, t, g, unknown or other
  modified_base (607)..(607): a, c, t, g, unknown or other
  modified_base (610)..(610): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttatagaagcagacctgatggtgggacaacagagtacgctggattcgtaaaaggcagattcgccatctcaattgatgagtacaaagaacacgtgtatctaggaaatgagcagccgtaggaaagcgatgacacgagactntattatgaccataagacgtaccaacgaagtactggtagggaagggactggcgtcggggaccgaggggctccgttcgtccaccgtcctcctcacgtccctccgaccgaacgggcccctagtcccggtccccttccccgnggcccgtcccctcgtcccgtccgacgggaccgcccacccgtccgagaccgcgaaccgcggcccgggcccgtcggggcctacggcccgttggaccgaacggtacccttaaccctttcccaacgttactcgtacgtccggcggacggcgggacgtcggacgacggcactacgngcng

SEQ ID NO: 376284 - DNA, 503 bp, Homo sapiens
  misc_feature: GZ8MTXP02FI77F.10.35.D02.1.454.CMB.2.raw
  modified_base (200)..(200): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaactacttagcctggttgcagcacaactggccaggctcccaggctcctcatctatgctgcatccatcagggccactggcatcccagcagacttcagtgcagtggtctgggacagacttcatctacacatcagcagactgagcctgaagtatttgctagtctattactgtcagcagtatcgtcacgtccaagtacgtttcgacgtagggaccaacgcgtcggacgtactacgaaacgaacgtggtacggactagaccacactacg

SEQ ID NO: 376285 - DNA, 611 bp, Homo sapiens
  misc_feature: GZ8MTXP02G01RV.10.35.D02.1.454.CMB.2.raw
  modified_base (604)..(604): a, c, t, g, unknown or other
  modified_base (610)..(611): a, c, t, g, unknown or other
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatgggtggacaacagagtacgctggattacggtaaaaggcagattcgcatctacaattgatgatacaaagaacaccgtgtatcgaggaaatgagcagccgtaggaaagcgatcgacacgagactactattattcgaccaactaagacgtacccaagagtacgtggagggaaaggtcgtaggtcgacggggacccgagggtacgtccgttgtaccgccgtccgttcccgtcaccgtccctacccaacccgacgggtaccccctagtcccggttcccttccccgcggccctccccgtagcctacgacgacgcccaacgtccacgtacgccgaacgcggtcccggaccgcggcctacggtccgtggaacctacggtacctaccctaccgacttaaacgcgtacgcctggaccgtcggactgggacaggcntacgcnn

SEQ ID NO: 376286 - DNA, 684 bp, Homo sapiens
  misc_feature: GZ8MTXP02GK6QB.10.35.D02.1.454.CMB.2.raw
  modified_base (201)..(201): a, c, t, g, unknown or other
  modified_base (290)..(290): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaanacgccaccctctcctgcagggccagtcactatgttagtgacaactacttagcctggttgcagcacaactgccaggcctccgagctcctnatctatgctgcactccatccgagggccacgtggacctaccgtcccgaggccaggtaccttcgagtcggacgtaggttcggtacgtcggggactacgtaccgttccaccgtctaccgaacctatacgacgacgagtaaccgttcgggaaacgtcccgttaggtaaagttacgttttagacgttaacggtttacttaaactttacgttcgtaccgtaggtaccgttagtttaacgtccgggttaacctaaacccggttacccggttaaaacgttaccgggttttaccgggaacccgggtaaacgggggtaaaccctacggtaaccggtagggtaaacgtaacgtaacgttaaaaaccgaacgttcggacgtacggtacgacctaacgtactttccg

SEQ ID NO: 376287 - DNA, 603 bp, Homo sapiens
  misc_feature: GZ8MTXP02IR7FB.10.35.D02.1.454.CMB.2.raw
  modified_base (458)..(458): a, c, t, g, unknown or other
  modified_base (472)..(472): a, c, t, g, unknown or other
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgctaattttaaaaggtgtccagtgtgacgtgcagttggtggagtcgtgggggaggtcgttgggttaacggccggggggtcccttaggactcctcctgttcagcctcgtggattcagtgtcactacgctggatgagcgtggtccgccacggtccccgaggggaacggggctgggaggtgggttgccgtttagtaggaagcagcctggagtgggtaggacaacgagacgtacgctggagttacgaaaaggcagtattccgcactctactatgattgatacgaaaagacacgtanagtacgtagaaagngagcgagaccgtagagacgatacgaacacgagacttactatttacttacgtaaaccgtaactacgtaacgtacccgtaaacggaaacgtacgtagggtacggggtaacggtaccgtgggaccggtcggggg

SEQ ID NO: 376288 - DNA, 696 bp, Homo sapiens
  misc_feature: GZ8MTXP02JK8X9.10.35.D02.1.454.CMB.2.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggtattttccttgctgctaattttaaaaggtgtccagtgtgacgtgcaggttggtggagtcggtgggggaggtcgttgggttaacgggcccggggggtcccttaggacctccgtccttgttccgacgtcccttcgtggtattcgagtcgtacaacgtaacgcctggatcgaggtcgtcgggtccgcccgacgtcccccggaagggggaacgggtcgtagggtaggttggggttcggtaccgtttaagttaggaacgtcgaacgtaccgtaggagtacgggtaggaacgaacgagtacggtacgtcgtaggtaacgttacggaaaggccagtacttaccgctactcgtactaagttgactagaacgtaacgaaacgtaaccgtacgtagtacgttacgtagtaaagtgaagtcgacggtaccgaggaaagcgaagtacgacgaagtaacgacctttaacgttagttaacttacgtaacctaacggtaacgtaccgtaccctaaagaaccgtaggtacggtacgggagtcgtaggccggtacgggg

SEQ ID NO: 376289 - DNA, 556 bp, Homo sapiens
  misc_feature: GZ8MTXP02I1NOY.10.35.D02.1.454.CMB.2.raw
  modified_base (198)..(198): a, c, t, g, unknown or other
  modified_base (208)..(208): a, c, t, g, unknown or other
  modified_base (294)..(294): a, c, t, g, unknown or other
  modified_base (346)..(346): a, c, t, g, unknown or other
  modified_base (379)..(379): a, c, t, g, unknown or other
  modified_base (394)..(394): a, c, t, g, unknown or other
  modified_base (414)..(414): a, c, t, g, unknown or other
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgctcgagggaaanagccaccctntcctgcagggccagtcactatgttagtgacaacttacttagccttggttcgcagcaacaaacctggaccaggctcccaggcctccncatcagtgctgcatccatcgaggccacgtggcactcccaggcagatcagtgntagtggctggggactagtaccgttcacttaccncaacatcagcagagngacgctagtacgtgttacgngtagttcttaagttctgacgagtactagttacgtcgtactaccgtactaaagttaccgttcggaacggtacgggaactaggtacgtaggaacgaacgtaacgaaaccgtaagtcgtcgacgttacgacctaacgtacgttcg

SEQ ID NO: 376290 - DNA, 533 bp, Homo sapiens
  misc_feature: GZ8MTXP01EZESL.4.81.H04.1.454.CMB.2.raw
  modified_base (437)..(437): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatctcagggactttgacatgaattgggtccgccagggctccgaggggaagggggctgggagtgggtctcatccatcagttccccagtactcgtacataatactcgcagactcagtgaggggcccattcaccatctccagagacaacgccaaagactcagttgttcngacaaatgaacagcctgagagtcgaggactcggctgttctacttacgtgtgcggaggaagtaaggggatctaaccccgtagatttcggaactaacg

SEQ ID NO: 376291 - DNA, 549 bp, Homo sapiens
  misc_feature: GZ8MTXP01B9HV8.4.81.H04.1.454.CMB.2.raw
  modified_base (362)..(362): a, c, t, g, unknown or other
  modified_base (407)..(407): a, c, t, g, unknown or other
  modified_base (435)..(435): a, c, t, g, unknown or other
  modified_base (439)..(439): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatcttcagggactttgacatgaagttgggtccgccaggctccgaggggaaggggcgtggagtgggtctcatccatcagttcagtacctcgttanatactactaacgcaagactcgagtggaggggccgattcaccatcnccagagacaacgaccaagaactcagttnttcngacaaatgaaacagcctagagagtacgaggtactcggctgtaactacttcgtgttggacgaaggaagttaagggacgtcctaccctaagtattggactaacgttgtaacg

SEQ ID NO: 376292 - DNA, 535 bp, Homo sapiens
  misc_feature: GZ8MTXP01DWJP7.4.81.H04.1.454.CMB.2.raw
  modified_base (467)..(467): a, c, t, g, unknown or other
  modified_base (514)..(514): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcactggtggagtcgtgggggaggcctggtcaaaccgtggggggtccctgagactctcgtgtgtagtctctgaattcatctcagggactttgacatgaattgggtccgccaggctccgaggggaaggggctgggagtgggtctcatccatcagttccccagtactcgttacataactactcgcagactcagtggaggggccattcaccatctccagaacgacaacgccaaagaactcaagttcgtttctagactaaatgaaacagcctgaagngtcgaggactcggctgttctacgttactgtgacgagaaagtaagganctaccagttattggaactaag

SEQ ID NO: 376293 - DNA, 527 bp, Homo sapiens
  misc_feature: GZ8MTXP01EOSB5.4.81.H04.1.454.CMB.2.raw
  modified_base (425)..(425): a, c, t, g, unknown or other
  modified_base (434)..(434): a, c, t, g, unknown or other
  modified_base (448)..(448): a, c, t, g, unknown or other
  modified_base (457)..(457): a, c, t, g, unknown or other
  modified_base (482)..(482): a, c, t, g, unknown or other
  modified_base (486)..(486): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggagcctggtcaaaccgtgggggtccctgagactctcgtgtgtagtctctgaattcatctcagggactttgacatgaattgggtccgccaggctccgaggggaaggggctgggagtgggtctcatccatcagttcccagtactcgtacataaactactcgcagactcagtggaggggccattcaccatctccagagacaacgccaaagactnagtgtttcngactaaatgaaacngcctgaagngtcgagactggctgttctacttagngtgngaggaataaggggatccaaccctagagtttaaggaacaacg

SEQ ID NO: 376294 - DNA, 529 bp, Homo sapiens
  misc_feature: GZ8MTXP01APC0I.4.81.H04.1.454.CMB.2.raw
  modified_base (453)..(453): a, c, t, g, unknown or other
  modified_base (463)..(463): a, c, t, g, unknown or other
  modified_base (501)..(501): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatctcagggactttgacatgaattgggtccgcaggctccgaggggagggctggagtgggtctcatccatcagttccccagtactcgttacataactactaacgcagactcagtgagggcgattcacatctccagagacaacgaccaagaactcagttcgttctgacaaatgaacagcctgagngtcgagtacngggctgttctacttacgtgtgcgttaggaagtaagggngcctacccgtagagtttcggaactaacg

SEQ ID NO: 376295 - DNA, 549 bp, Homo sapiens
  misc_feature: GZ8MTXP01AZZO7.4.81.H04.1.454.CMB.2.raw
  modified_base (406)..(406): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatcttcagggactttgacatgaattgggtccgccaggctccgagggaaggggctggagtgggtctcatccatcagttccagtacctcgttacatatactaacgcaagactcagtgaggggcgattcaccatctcaganacaacgccaagactcagtgttctgacaaatgaacagcctggacgagtacgaggactcggctgtctacttactgttgacggaagggaagttaaggggacgtcctaacccctaacgtaagttttcgggactaacgaaggtaacgg

SEQ ID NO: 376296 - DNA, 572 bp, Homo sapiens
  misc_feature: GZ8MTXP01D24X3.4.81.H04.1.454.CMB.2.raw
  modified_base (406)..(406): a, c, t, g, unknown or other
  modified_base (426)..(426): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtggggggtccctgagactctcgtgtgtagtctctgaattcatcttcagggactttgacatgaattgggtccgccaggctccgaggggaaggggctggagtgggtctcatccatcagtccagtacctcgttacatatactaacgcaagactcagtgaggggcgattcacatctcaganacaacgccaaagactcagtntttactgacgaaatgaaactagcctagacgagtacgaggtactcggctgtctacttacgtgttggacggtaaggaaaacgttacgggggaactaacccttaaaccccgtaacggtaagtttcgggaactaaccgaaggttaaccgg

SEQ ID NO: 376297 - DNA, 606 bp, Homo sapiens
  misc_feature: GZ8MTXP01DEFXG.4.81.H04.1.454.CMB.2.raw
  modified_base (340)..(340): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatctcagggtactttgacatgaagttgggtccgccaggctccgagggggaaggggctgggagtgggtcncatccatcagttcccagtactcgttaacattaaactactaacgcaaggactcgagtggagggggaccgtattcaccatctaccaagagacaacgaccaagaactcagttgttcgtagacaaatagaaactacgcctaggaagtaggtacgagggtaccgtcggcttcggttcctaaccttaacgttggtcggaccggaaagggttaaagttaaacgggggactaaccgttaaaccccgtaggttaacgtttcgggaaactaaccgg

SEQ ID NO: 376298 - DNA, 551 bp, Homo sapiens
  misc_feature: GZ8MTXP01BYKUV.4.81.H04.1.454.CMB.2.raw
  modified_base (408)..(408): a, c, t, g, unknown or other
  modified_base (440)..(440): a, c, t, g, unknown or other
  modified_base (455)..(455): a, c, t, g, unknown or other
  modified_base (494)..(494): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtggggggtccctgagactctcgtgtgtagtctctgaattcatctcagggtactttgacatgaattgggtccgccaggctccgaggggaaggggctgggagtgggtctcatccatcagttccccagtactcgttacataatactcgcagactcagtggaggggcccattcaccatcnccagagacaacgccaaagactcagttgtttcngactaaatcgaaacngccgttgaagagtcggaggctcggctgttctacttacgngtgacggaggaaactaaggggactccttaaccccgtaggttatttcgggaacctaag

SEQ ID NO: 376299 - DNA, 538 bp, Homo sapiens
  misc_feature: GZ8MTXP01A29Q2.4.81.H04.1.454.CMB.2.raw
  modified_base (370)..(370): a, c, t, g, unknown or other
  modified_base (397)..(397): a, c, t, g, unknown or other
  modified_base (404)..(404): a, c, t, g, unknown or other
  modified_base (426)..(426): a, c, t, g, unknown or other
  modified_base (454)..(454): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctgggggtccctgagactctcgtgtgtagtctctgaattcatctcagggactttgacatgaattgggtccgccaggctccgagggaagggggctggagtgggtctcatccatcagttcagtacctcgttacatatactaacgcngactcagtgaggggccgattcacatcncagacanaaacgcaaagactcagtgttcngacaaatgaacagctgagagtcgagtcnggctgtctacgttactgttcggacgaaggaaagttaaggggactaacctaaccctaaggtattacgggacctaagaagtaacgg

SEQ ID NO: 376300 - DNA, 648 bp, Homo sapiens
  misc_feature: GZ8MTXP01C2D6T.4.81.H04.1.454.CMB.2.raw
tcagagcactgtagcacgaccggtgctcgatttagtagtgtagattcgcggggtctgagagaggagccttagccctggattccaaggcctatccacttggtgatcagcactgagcaccgaggattcaccatggaactggggctcgctgggttttccttgttgctattttagaaggtgtccagtgtgaggtgcacctggtggagtcgtgggggaggctggtcaaaccgtgggggtccctgagactctcgtgtgtagtctctgaattcatcttcagggactttgacagtgaagttgggtccgcaggctccggaggggaagggggcgtgggagtgggtctcgatccatcagtcagtaccctcgtacataatactaacgcaagactcgaggtggacgggggccattccaacctatcctaccaagaacgaaccaaacgaccaaaagaaccttcgtaagttcgtttactacgaacgtaaaagttacggaaaaccacggtccctaaggaacggtaaggttaccgggaacggtaaccgtccgggccttaggttaaccttaacgttaacgttggacggacggaaagggttaaagttaacgggggactaacccgtaacccgtaaggttaacgttacgggaacctaacgaaggttaacg

SEQ ID NO: 376301 - DNA, 686 bp, Homo sapiens
  misc_feature: GZ8MTXP01BQZ4Y.4.81.H04.1.454.CMB.2.raw
  modified_base (505)..(505): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctatttagaaggtgtccagtgtgaggtgcacctggtggagtcgtgggggagcctggtcaaaccgtgggggtccctgagactctcgtgtgtagtctctgaattcatctcgagggtactttgacatgtaagttcgggtccgccaggctccggagggggaaggggcgtgggaggtgggtctcactccatcacgttccccagttactcgtacataaactactcgcagactcgaggtcggacggggcctagttccacctatcctaccgaagaacgaaccaaccgaccaaacggtaactcgtaaggtttcgtttacgtacggtaactaaaagttacggaaaaccncggtacccgttagggaaacggtaacggttaccgggaaacgggtaacccgttccgggggtaactttacgggtttacccttaaccgttacgttgggttacggaacgggttaaagggttaaaggtaaacgggggtacgtaaccccgttaacccgtacggttagtttaaccgggaactaaccggg

SEQ ID NO: 376302 - DNA, 571 bp, Homo sapiens
  misc_feature: GZ8MTXP01AY6RY.4.81.H04.1.454.CMB.2.raw
  modified_base (368)..(368): a, c, t, g, unknown or other
  modified_base (457)..(457): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatcttcagggactttgacatgaattggtccgcaggctccgagggagggctggagtgggtctcactccatcagttccagtacctcgtacatactactaacncaagactcgaggtggacggggccgattccaccgtatctaccgagacgaacaaccgacaaagaactcagttgtttacagacaaatgaacngacctgacgagtacgagtacctggcttgtaactacttacgtggttgacgggaagaacgttaggggactaacccgtacccgtaagtactttacgggaactaacgttaagtaacgg

SEQ ID NO: 376303 - DNA, 545 bp, Homo sapiens
  misc_feature: GZ8MTXP01CW4QA.4.81.H04.1.454.CMB.2.raw
  modified_base (373)..(373): a, c, t, g, unknown or other
  modified_base (439)..(439): a, c, t, g, unknown or other
  modified_base (452)..(452): a, c, t, g, unknown or other
  modified_base (492)..(492): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatctcagggactttgacatgaatggtccgccaggctccgagggaaggggcgtgggagtgggtctcgatccgatcagttcccagtactcgttacataactacncgcagactcagtgagggccgattcactatctacagagacaacgacaaagaactcaagtgtttacgngacaaatgaaacngcctgaagagtcgaaggactcggctcgctacgacgttggngacgttaggaagtaaggggactctaacccgtaggttatttaacggaacctaag

SEQ ID NO: 376304 - DNA, 655 bp, Homo sapiens
  misc_feature: GZ8MTXP01CPHOT.4.81.H04.1.454.CMB.2.raw
  modified_base (499)..(499): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgctattttagaaggtgtccagtgtgaggtgcaccgtggtggagtcgtgggggaggccgtggtcaaaccgtgggggtccctgagactctcgtgtgtagtctctgtaattcattctcgagggtactttgaacagtgtaagttcgggtcccgccgacgggcctccggaagggggaacgggggctgggaggttgggtctcatccatcacgttccccactactcgttacataactactcgcaagactcgagtggacggggtccattccgactactcctaccgaagaacgaaccaacgacccaaagaacctcgagttctttcgacgataaatcgaaacngaccgtagaagtacgtacggaaggaccggtcggcttaggttaccttaacgacgttacgggtaaggaccggttaaaggggttaaaacgttaaacgggggaaccttaaccccgttaaacccggtaacggttaacggtttaaccggaacgtaaaccggg

SEQ ID NO: 376305 - DNA, 553 bp, Homo sapiens
  misc_feature: GZ8MTXP01E3FNE.4.81.H04.1.454.CMB.2.raw
  modified_base (435)..(435): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggagcctggtcaaaccgtggggggtccctgagactctcgtgtgtagtctctgaattcatctcagggtactttgacatgaagttgggtccgccaggctccgagggggaaggggctgggagtgggtctcgatccatcagttccccagtactcgttacataaatactcgcagactcagtggaggggccattcaccatctcagagacaacgccaagactcagttnttcgtgacaaatcgaaactcgcctgagagtcgaggctcgggctgttctattacgtggtcgacggttaaggaagttaaggggctaaccttaaccccgtagttatttcgggaactaacgg

SEQ ID NO: 376306 - DNA, 673 bp, Homo sapiens
  misc_feature: GZ8MTXP01BYI6F.4.81.H04.1.454.CMB.2.raw
  modified_base (392)..(392): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgcttgggttttccttgttgcttattttagaaggtgtccagtgtgaggtgcaccgtggtggagtcgtgggggagcctggtcaaaccgtgggggtcctgagactctcgtgtgtagtctctgaattcattctcgagggtactttggactagtagtaagttcgggtcccgacgaggcctaccggaggggaaggggcgtgggagtgggtctcatccatcacgttcagttacctcgttacatatactaacgcngactcgaggtggacgggggaccctagttaccacctagtcctaccgaagaaccgaaccaaaccggaccaaagtacctcacgttgtttaccagaacctaaaatcggaaaccacgaccgtagaacggtagtaaccgggagtaccgtcgggtcttcggtaaccttaacgttacgtacgttcggaaccgggtaaaggttaaacgggttaaacggggaaccgttaaccccgttaaccccgttaaggttaacgtttaccggaaactaacccggttaaggttaacccgg

SEQ ID NO: 376307 - DNA, 642 bp, Homo sapiens
  misc_feature: GZ8MTXP01DNDM1.4.81.H04.1.454.CMB.2.raw
  modified_base (466)..(466): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcaccgtggtggagtcgtgggggagcctggtcaaaccgtggggggtccctgagactctcgtgtgtagtctctgaattcatctcgagggtactttgactagtgaagttgggtcccgcgaggctccggaagggggaaggggctgggaggtgggtctcgatccatctacgttccccagtactcgttacataaactactaacgcagactcgagtgggacggggccattcaccactctaccagacgaacaacgaccaaagactctagttgtttacgngaactaaatacgaaacacgcctaggaacggtacgtacgggaaggtaccgtccgggtcttcgggttaccttaaccgttacgtggttcgggaaaccgggttaaagggttaaaacggttaacgggggaactaacccgttaaaccccggtaaggttacgtttaacgggaactaaaccggg

SEQ ID NO: 376308 - DNA, 847 bp, Homo sapiens
  misc_feature: GZ8MTXP01AGWVJ.4.81.H04.1.454.CMB.2.raw
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgcttgggttttccttgttgcttattttagaaggtgtccagtgtgaggtgcaccgtggtggagtcgtgggggagcctggtacaaaccggtgggggtccctgagactctcgtgtgtagtctctgaattcattcgtcgagggtactttgactagtgtaacgttcggggtcccgaccgaggccgtaccggaagggggaacgggggcgtgggaggttcgggtctcgtactccgtatccgtacgttaccgtagttaccccttacgttaactaattaacttaaccgtaaccgactaacgtaccgtaccgtaagggttacggggaccgggggtacctaaactttacccgaacccgttactttaccccgtaaccggaaacgggaaccgaaaacccgaaaaccccggaacccgtaaaaacgggtaaccctttacccggtaaggtttttaccggttttaccgtaaacggttaaaccaaaagtttaaccggaaacgtacccggtaccgttaaggggaacgtacggggtaaccgggtaaacgggtcccgttccggggtacctttcgtttaacccgttaacggttaaccggtgggttaaaccgggaccggggtaaaacggttaaagggttaacgggggttaacccttaacccgtttaaaccccggttaagggttaagtttaaccgggaaccctaaggttaacgtttaacccggggg

SEQ ID NO: 376309 - DNA, 534 bp, Homo sapiens
  misc_feature: GZ8MTXP01BWG7W.4.81.H04.1.454.CMB.2.raw
  modified_base (457)..(457): a, c, t, g, unknown or other
  modified_base (506)..(506): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggtttccttgttgctattttagaaggtgtccagtgtgaggtgcacctggtggagtctgggggaggcctggtcaaaccgtggggggtccctgagactctcgtgtgtagtctctgaattcatctcagggactttgacatgaattgggtccgccaggctccgaggggaaggggctgggagtgggtctcatccatcagttccccagtactcgtacataatactcgcagactcagtgaggggccattcaccatctccagacgacaacgccaaagactcagttgtttctgacaaatgaacacgcctggagngtcgaggactcggctgttctacttcgtgtgcggaggaagtaaggggacncctacccgtagacgtttcggaactaacg

SEQ ID NO: 376310 - DNA, 680 bp, Homo sapiens
  misc_feature: GZ8MTXP01CMRRK.4.81.H04.1.454.CMB.2.raw
  modified_base (499)..(499): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgctattttagaaggtgtcagtgtgaggtgcacctggtggagtcgtgggggagctggtcaaaccgtcgggggtcctgagactctcgtgttgtagtctctgtattcattctcgaggtactttgactatgtaagttcgggtcccgaccgaggtctaccggagggggaacgggcgtgggaggttgggtctcgatccatcagttccccagtactacgttacataatactcgcagtactcgagtggacggggctattaccactatcctaccagaacgaaccaacgaccaaagtaactcgtagttacgtttcgaacgtaactaaaacgttacgaaaaccncggtacccttagggaaacggtacggttaacccgggaaacgggtacccggttacgggccgtttacgttaacccgttttaacacggttaccggttagggaaaccggttaaaggggttaaaccggtaaggggtaacgtaaccccgttaacccggtaagttacgtttaacggcgttaaacccggg

SEQ ID NO: 376311 - DNA, 546 bp, Homo sapiens
  misc_feature: GZ8MTXP01C7SXI.4.81.H04.1.454.CMB.2.raw
  modified_base (520)..(520): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtcccctgagactctcgtgtgtagtctctgaattcatctcagggactttgacatgaattgggtccgccaggctccgaggggaagggggctgggagtgggtctcatccatcagttcccagtactcgttacataatactcgcagactcagtgaggggccattcacatctccagagacaacgccaaagaactcaagttcgtttcgtgactaaatggaaacagcccttggaagagtcgagggtactcggggctggttctacttacgtgtgacgaggaagtaagggganccgtacctacgatttgggaactaacg

SEQ ID NO: 376312 - DNA, 556 bp, Homo sapiens
  misc_feature: GZ8MTXP01DYT24.4.81.H04.1.454.CMB.2.raw
  modified_base (464)..(464): a, c, t, g, unknown or other
  modified_base (473)..(473): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtggggggtccctgagactctcgtgtgtagtctctgaattcatctcagggtactttgactatgtaagttgggtcccgccaggctccgagggggaagggggctgggagtgggtctcgatccatcacgttccccagtactcgttacataactactcgcagactcagtggagggcatcactatctcagacgacaacgacaagaactcaagttcgtttactagactaaatcgaaacngcctgaagnggtcgaggactcgggctgttcgtacttacgtgtgcggaggaaagtaagggagtcctacccgtacgttagtttcggaactaacg

SEQ ID NO: 376313 - DNA, 635 bp, Homo sapiens
  misc_feature: GZ8MTXP01APY2H.4.81.H04.1.454.CMB.2.raw
  modified_base (473)..(473): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgctattttagaaggtgtccagtgtgaggtgcacctggtggagtcgtgggggagcctggtcaaaccgtggggggtccctgagactctcgtgtgtagtctctgaattcattctcgagggtactttgactatgtaagttcgggtcccgccgagggcctccggagggggaagggggcgtgggagtgggtctcatccatcagttccccagttactcgttacattaactacctcgcagacttcaggtggacggggcctattccaccattccaccagacgaccaaacgccaaagtactcgtaagttcgtttacngaactaaaatcgaaaccaggtcccttaggaacggtacggttccggaaggtacccgttcgggaacttcggttacctacgttacgtgggtacggaccgggaagggttaaacggtaacgggggtctaacccgttaaccgtaggttacgttaacgggaactaacgg

SEQ ID NO: 376314 - DNA, 590 bp, Homo sapiens
  misc_feature: GZ8MTXP01AESLR.4.81.H04.1.454.CMB.2.raw
  modified_base (337)..(337): a, c, t, g, unknown or other
  modified_base (379)..(379): a, c, t, g, unknown or other
  modified_base (507)..(507): a, c, t, g, unknown or other
  modified_base (514)..(514): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggagcctggtcaaaccgtggggggtccctgagactctcgtgtgtagtctctgaattcatcttcagggactttgactatgaagttcgggtccgccaggctccgagggaaggggctggagtgggtctnatccatcagttccagtaccctcgttacatatactaacgcaanactcgagtgaggggtcattcacatctaccagacacaaccgccaaagacctacgagttggttctaggacaaaagtcggaaacacgacctggagagtacggaggaccttcgggcttggttctaaccgttnttagggngtaacggaaggttaacgttaacgggactaacccgttaacccgtaagttaacgttacggactaacgttaaggtaacg

SEQ ID NO: 376315 - DNA, 626 bp, Homo sapiens
  misc_feature: GZ8MTXP01AHJ3G.4.81.H04.1.454.CMB.2.raw
  modified_base (301)..(301): a, c, t, g, unknown or other
  modified_base (363)..(363): a, c, t, g, unknown or other
  modified_base (418)..(418): a, c, t, g, unknown or other
  modified_base (452)..(452): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggagcctggtcaaaccgtggggggtccctgagactctcgtgtgtagtctctgaattcatcttcagggactttgacagtgaattgggtccncgaggctccgaggggtaagggctggagtgggtctcagtccatcagttccagtacctcgttanatatactaacgcaagtactcaggtgagggggccattacacctatcctccaagganaacaaacgaccctaaagaaacctccgtaaggttntttacgtacggacaaaagtcggaaacacggacccttggaaaccgggtacggtacggaacgggtccgtacggtctacgtaacctaacgttaggtcggaggaacggaaggttaacgttaacgggaccgtaacccgtaacccgtaagttacgttacggaactaacgttaaggtaacg

SEQ ID NO: 376316 - DNA, 654 bp, Homo sapiens
  misc_feature: GZ8MTXP01C8G7Q.4.81.H04.1.454.CMB.2.raw
  modified_base (350)..(350): a, c, t, g, unknown or other
  modified_base (482)..(482): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgctattttagaaggtgtccagtgtgaggtgcaccgtggtggagtcgtgggggagcctggtcaaaccgtgggggtccctgagactcgtcgtgtgtagtctctgaattcatctcgagggtactttgactagtgtaagttgggtccgccaggcctccggagggggaagggcgtgggagtcgggttcnctatccatcacgttccccagtacttcgtacataactactaacgcacgactcgagtggacgggccgtattcaccatctcagacgaacaacgacaacgaactcaagttcgttacgtacgtacaaagtcgaaacncgtacctaggtaaggacggttcggaacgggtacgtccggtcgttacgttaccgttaaccgttacgttacggtggttaaaccgggttaagggttaaaacgggtaaacggggtaaaccgtaaccccgttaacccggttaaccggttaagttttaaccgggaacgttaaaccggg

SEQ ID NO: 376317 - DNA, 582 bp, Homo sapiens
  misc_feature: GZ8MTXP01AC4HJ.4.81.H04.1.454.CMB.2.raw
  modified_base (407)..(407): a, c, t, g, unknown or other
  modified_base (444)..(444): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggagcctggtcaaaccgtgggggtccctgagactctcgtgtgtagtctctgaattcatctcagggtactttgacatgaagttcgggtccgccaggctccgaggggagggctgggagtgggtctcatccatcgagttccccaggtactcgttacattaactactcgcaagactcagtggaggggcctattcacntctaccagagacaacgacaaacgactacagttgttcngaacaaagtcgaaaccagccgtagaagacggttcgggaaacgtcgtcggcgttacgttctaacgttacgtggtaggacggagggttaaagttaaggggactaaccgttaacccgtagttagttttcgggaactaaccg

SEQ ID NO: 376318 - DNA, 668 bp, Homo sapiens
  misc_feature: GZ8MTXP01BIKRR.4.81.H04.1.454.CMB.2.raw
  modified_base (265)..(265): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttccttgttgctatttagaaggtgtccagtgtgaggtgcacctggtggagtctgggggagcctggtcaaaccgtgggggtccctgagactctcgtgtgtagtctctgattnatctcaggtactttgacatagaagttgggtccgccgaggcctccgagggggaaggggcgtgggaggtgggtctcactccatctacgttccccagttactcgttacattaatactcgcagactcgagtggacggggcctattcgacctatcctcagaacgacaacgaccaaagaacctcgtaagttcgtttacgtacgaactaaagttacggaaacgcggtacccgttagggaagtacgggtaccgggtaaacgggtaccggtccgggtaacgtttcgttaccgttaacgttaccggtttagggaccgggttacgggttaaaggggttaaacggtaaaacggggaccgttaacccgtttaaacccccgtagggttacttttaaccgggggaaaccttaaccggg

SEQ ID NO: 376319 - DNA, 749 bp, Homo sapiens
  misc_feature: GZ8MTXP01C7HGY.4.81.H04.1.454.CMB.2.raw
  modified_base (284)..(284): a, c, t, g, unknown or other
  modified_base (328)..(328): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcacatggaacgtggggctccgtcgttgggttttccttgttgtcttattttaggaaggtgtcagtgtgaggtgcacgtggtggagtcggtgggggacggtccgtggtaccgaaaccggtcggggggtccctggacgtactcgtcggtgtgtagtctntgtaattcatctcgaggtactttgactagtagtagttcggtccncgaggctaccggaagggggtagggcgtagggaggttcgggtctcgtatccagttcgtacgttcccccaaggttacttacgttaactaacgttaaactaaccgtaaccgacgtaaacgtaccttacggaacgggtacggggtacggggtaccctaacgttaccctaaaccacggttaccaacccgaaaggaaaccggtaaacccgaaacccggtaacctaaaaacggttacctacgttaacgggttttacgtttaccgtaacggtaaaccgtaaaagtacggaaaccgacgtacccggttaggaaccggaagggtaccgtacgggtaccgtcgggtaacttcgttacctaacgttcgttagtacgggaggaaggttacgtaagggcctaaccgttaccgtagttacgttaacgaacgtaacg

SEQ ID NO: 376320 - DNA, 809 bp, Homo sapiens
  misc_feature: GZ8MTXP01C10GJ.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgctattttagaaggtgtccagtgtgaggtgcacgtggtggagtcgtgggggaggccgtggtacgaaaccgtgggggtccctgagactctcgtgtgtagtctctgtatcatctcgagggtactttgactagtgtaacgttcgggtcccgacccgacgggccgttacccggaaggggggtaacgggggtcgtagggggtacgggtttcgggggttacctacgtacgttacccgtaagttccgtaacggtttacccccgtaaacggttttaaccgttaccggtttaaaccctaagtttaaaaccttaaccgttaaccggactaaacggtaccgttacgtaaggggttacggggtaacggggggtaccctaacgtttacccgaacccttaacgttacccgtaaccgaaacgggaaaccgaaacccgaaacccggaacccgtaaaacgtaacccgttacgtaggtttacgtttacgtaacgaactaaagtacgaaacgtacgccgtaggaacgtacggtacggtaggtacgtcggtaacgttcgttacgttaccgttagttgtacggaacggttaagggaaaacggttaaggggtaccgtaacccgtttaacccggtacgttaacggtttaacggaaccgttaacggg

SEQ ID NO: 376321 - DNA, 838 bp, Homo sapiens
  misc_feature: GZ8MTXP01CECZI.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgcttattttagaaggtgtccagtgtgaggtgcacctggtggagtcgtgggggagccgtggtcaaaccgtgggggtccctgagactctcgtgtgtagtctctgaattcattctcgagggtctttgactagtgtaagttcgggtcccgaccgacgggccgtaccggaggggggaacgggggtcgtaggggtacgggttcgggggttcctacgtactaccgtaacgttcgtaacggtttacccccctaacggtttaaccgttaccggtttaaacctaaacgttaaaacttaacccgttaaccggaccgtaaacgtaacccgttaccggtaaggggttacgggggaacggggggtaccccttaaacgtttacccgaaacccctaaggttcccccttaaacccgaaagggtaaaccggtaaaccccgaaaaccgggttacccaaaaaggaaacccctttacggtaaggtttacgggtttttacaacgggtaaacctaaaagttaccgggaaaactaccggtcccgttaaggaacgggttacggttaacccggaaggttacccggtcgggtccttacggttacctaaacccgttgtacgggttgaaccgggttaaaggttaaacggttaacggggacttcccggttaacccgtagttacgtttaacggaacgtaacgg

SEQ ID NO: 376322 - DNA, 576 bp, Homo sapiens
  misc_feature: GZ8MTXP01C0YJ2.4.81.H04.1.454.CMB.2.raw
  modified_base (369)..(369): a, c, t, g, unknown or other
  modified_base (400)..(400): a, c, t, g, unknown or other
  modified_base (405)..(405): a, c, t, g, unknown or other
  modified_base (424)..(424): a, c, t, g, unknown or other
  modified_base (429)..(429): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggtttccttgttgctattttagaaggtgtccagtgtgaggtgcacctggtggagtcgtgggggaggcctggtcaaaccgtggggggtccctgagactctcgtgtgtagtctctgaattcatcttcagggactttgacatgaagttggtccgcaggctccgagggaggggctggagtgggtctcatccatctagtcagtacctcgttacatatactaacgnaagactcgagtggacggggctagtcacatcncaganacaacgccaagactcagtnttacngacaaatgaactacgcctagagagtacgaggtactcggacttggtaacctacgttacgtggttcggacggtaagggaaagttaacgggggactaacccgttaaacccgtaacggtatttacgggaactaaccgttaaggttaaccgg

SEQ ID NO: 376323 - DNA, 615 bp, Homo sapiens
  misc_feature: GZ8MTXP01EYZ3F.4.81.H04.1.454.CMB.2.raw
  modified_base (307)..(307): a, c, t, g, unknown or other
  modified_base (362)..(362): a, c, t, g, unknown or other
  modified_base (373)..(373): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatcttcagggactttgacatgaattgggtccgtcaggcnccgagggaagggggctgggagtgggtctcatccatcagttccagtacctcgttanatatactaacncaagactcaggtggacggggtccgatttccacctagtcctaccgagacgacgaaaccgaccaaagtaacctacctagttcgtttacctagaacgtaaattagaacaacgcctaggagtacgtcggaggtaccgtcgggacttcggtaacttaacttcgtaggttcggacgggtaaaggaacgttaagggacgtaacccgtacctaacggttaactttcgggaactaaccgaagggttaacgg

SEQ ID NO: 376324 - DNA, 654 bp, Homo sapiens
  misc_feature: GZ8MTXP01A07AN.4.81.H04.1.454.CMB.2.raw
  modified_base (640)..(640): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgcttgggttttccttgttgctattttagaaggtgtccagtgtgaggtgcaccgtggtggagtcgtgggggaggcctggtcaaaccgtgggggtccctgagactctcgtgtgtagtctctgaattcattcttcagggactttgactatgtaagttcgggtaccgccgaggcctaccgaggggaggggctgggagtgggtctcagtccatcgtacgtccagttaccctcgttacattacaccgtaacgctaagtctacgaggtcgggacgggggtacctattacccgaccattccacgaggacaaaccaaccgtaccgaaataccgttacgtagttacggttttacacgaccgtaaaagttgaaaaccgtcgtacccgtaggaaggtacggtacggaaacggtccgtcggtctacggttaacctagttaccggtgacggtacggaagttaaaggttaccgggttgtaaccccgttaccgtaagtcgttacggaaccnggttaagtaaccgg

SEQ ID NO: 376325 - DNA, 521 bp, Homo sapiens
  misc_feature: GZ8MTXP02GCFHI.4.81.H04.1.454.CMB.2.raw
  modified_base (434)..(434): a, c, t, g, unknown or other
  modified_base (499)..(499): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatcttcagggactttgacatgaattgggtccgccaggctccgaggggaaggggctgggagtgggtctcatccatcagttccccagtactgttacatatactcgcagactcagtgaggggccattcaccatctccagagacaacgccaagaactcagtgtttcngacaaatgaacagcctgagagtcgaggactcggctgtctactactgtcgcgaggaataagggganactaccctagatttggacaacg

SEQ ID NO: 376326 - DNA, 516 bp, Homo sapiens
  misc_feature: GZ8MTXP02HO4BX.4.81.H04.1.454.CMB.2.raw
  modified_base (437)..(437): a, c, t, g, unknown or other
  modified_base (459)..(459): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctgggggtccctgagactctcgtgtgtagtctctgaattcatcttcagggactttgacatgaattgggtccgccaggctccgagggaaggggctggagtgggtctcatccatcagtccagtacctcgttacatatactacgcagctcagtgaggggcattcaccatctccagagacaacgccaaagaactcagtgttctgacaaatgaacngcctgagagtcgaggactcggntgtctactactgtgacgaggaataagggatctaccctagacttggaacacgagtacg

SEQ ID NO: 376327 - DNA, 577 bp, Homo sapiens
  misc_feature: GZ8MTXP02JHU33.4.81.H04.1.454.CMB.2.raw
  modified_base (471)..(471): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagtaaggtgtccagtgtgaggtgcacctggtggagtcgtgggggagggcctggtcgaaacctcgggggtccctgagactctcgtgtgtacgtctctcgtaacttcgactccttcacgggacctttggacactcgaaacgttggggtccgccaagggccgtccccgacggggaagggggcctgggacgtggggtctacgacttccactcagttccagtaccctcgttacatactacgtacgcagactcagtgaggggccgatcaccatctccagagacaacgccaagaactcagtgtttacngacaatgaacagctagagagtacgagcgtcgctgtactactacgtgtagacggaagtaacgtaaggactaaccgtaaccgtacgtacgttacggacacgtagtacg

SEQ ID NO: 376328 - DNA, 535 bp, Homo sapiens
  misc_feature: GZ8MTXP02HO8DE.4.81.H04.1.454.CMB.2.raw
  modified_base (338)..(338): a, c, t, g, unknown or other
  modified_base (403)..(403): a, c, t, g, unknown or other
  modified_base (408)..(408): a, c, t, g, unknown or other
  modified_base (434)..(434): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatcttcagggactttgacatgaattgggtccgccaggctccgaggggaaggggctggagtgggtctnatccatcagttccccagtactcgttacatactactcgcagactcagtgagggccattcaccatcncaganacaacgccaaagactcagttgtttcngacaaatgaacagcctagagagtcgagactcggctgtctactacgtgtacgcgtaaggaataaggggacaccttaacccgtagtacgtttacggactaacg

SEQ ID NO: 376329 - DNA, 527 bp, Homo sapiens
  misc_feature: GZ8MTXP02GWT46.4.81.H04.1.454.CMB.2.raw
  modified_base (403)..(403): a, c, t, g, unknown or other
  modified_base (408)..(408): a, c, t, g, unknown or other
  modified_base (428)..(428): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatcttcagggactttgacatgaattgggtccgccaggctccgaggggaaggggctgggagtggggtctcatccatcagttccccagtactcgttacatatactcgcagactcagtgagggccatcaccatcncaganacaacgccaaagactcagtntttactgacaaatgaacagcctagagagtcgagacgtcgctgtctactactgtcgacgaaggaataaggggacacgtacccagtactttcggactaacg

SEQ ID NO: 376330 - DNA, 557 bp, Homo sapiens
  misc_feature: GZ8MTXP02GDB4Y.4.81.H04.1.454.CMB.2.raw
  modified_base (438)..(438): a, c, t, g, unknown or other
  modified_base (492)..(492): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatctcagggactttgacatgaattgggtccgccaggctccgaggggaaggggctggagtgggtctcatccatcagttccagtacctcgttacatatactacgcagactcagtgacggggcattcaccatcctaccagacgaacaacgcccaaagactcagttgtttaccngacaaatgaaactagcctagagacgtacgagcctacggctgtacctacttacgnggtacgacgaggaaaacgtaaggggactaaccgtaacccgtagtacgttaggactaacgagtacg

SEQ ID NO: 376331 - DNA, 544 bp, Homo sapiens
  misc_feature: GZ8MTXP02IZXYY.4.81.H04.1.454.CMB.2.raw
  modified_base (275)..(275): a, c, t, g, unknown or other
  modified_base (298)..(298): a, c, t, g, unknown or other
  modified_base (363)..(363): a, c, t, g, unknown or other
  modified_base (373)..(373): a, c, t, g, unknown or other
  modified_base (441)..(441): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggtttcctgttgctattttagaaggtgtccagtgtgaggtgcacctggtggagtctgggggaggcctggtcaaaccgtggggggtccctgagactctcgtgtgtagtctctgaattcatcttnagggactttgacatgaattggcnccaggctccgagggaaggggctggagtgggtctcatccatcagttccccagtactcgttacatanactacgcaanactcagaggacgggacgactacacactcacagagacaacgacaaacgaacacagtgttctagacaaanacaacacgacgagagagtacgagacgtcgcgtgtactactacgtacgtacgacgaaggaaagtaaaggaacgacgtaaccgtacgtacgttacgtaacgaacg

SEQ ID NO: 376332 - DNA, 558 bp, Homo sapiens
  misc_feature: GZ8MTXP02FMUBI.4.81.H04.1.454.CMB.2.raw
  modified_base (431)..(431): a, c, t, g, unknown or other
  modified_base (435)..(435): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgattcatctcagggactttgacatgaattgggtccgccaggctccgaggggaaggggctgggagtggggtctcatccatcagttccccagtactcgtacatatactcgcagactcagtggaggggccgattccaccatctccagacacaacgcaaagactcagttnttcngactaaatgaaacagcctggagacgtcgaggtactcgggctacggtctaacttacgtggtacgaccggaaggaaagtaaagggggtacaccgttaccccgtagtacgtttcgggaactaacgg

SEQ ID NO: 376333 - DNA, 525 bp, Homo sapiens
  misc_feature: GZ8MTXP02FZ34G.4.81.H04.1.454.CMB.2.raw
  modified_base (434)..(434): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatcttcagggtactttgacatgaattgggtccgccaggctccgaggggaaggggctgggagtgggtctcgatccatcagttccccagtactcgttacatatactcgcagactcagtgaggggccgattcaccatctcagagacaacgcaagactcagtgttcngacaaatgaacagcctagagagtcgaggactcggactgtctactactgtgacgaggaagtaagggacactacctacgatttacggactacg

SEQ ID NO: 376334 - DNA, 520 bp, Homo sapiens
  misc_feature: GZ8MTXP02J5E4E.4.81.H04.1.454.CMB.2.raw
  modified_base (333)..(333): a, c, t, g, unknown or other
  modified_base (369)..(370): a, c, t, g, unknown or other
  modified_base (428)..(428): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcaccgtggtggagtctgggggaggcctggtcaaaccgtgggggtccctgagactctcgtgtgtagtctctgaattcatcttcagggtactttgacatgaattgggtccgccaggctccgagggagggctggagtgggtctnatccatcagttccagtacctcgttacatatctacgnngactcagtgaggggccattcaccatctccagagaccaacgccaagaactcagtgtttntgcaatgaacagcctgagagcgaggactccggctgtctactactgtgcgagaagtaaggaacgctaccctacgactttagacgtacagtacg

SEQ ID NO: 376335 - DNA, 609 bp, Homo sapiens
  misc_feature: GZ8MTXP02GV8RT.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgctattttagaaggtgtccagtgtgaggtgcacctggtggagtcgtgggggagcctggtcaaaccgtgggggtccctgagactctcgtgtgtagtctctagtaattcattcttcgagggtactttgactatgtaagttgggtccgccgagggcctccggaaggggaaggggcgtgggaggtgggtctcactccatctagttccccagtactcgttacattactactcgcaagtactcagtggacggggtcctattcaccatccacagacaccacgaccaagactcgtaagttgtttacagaactaaagtcgaaacagcctaggaacgtaggtaccggaggtacctcgggtacttacgtaccgttaaactcggtaggtacggaacggtaaggtaaaggtaacggggactacccgttaacccgtagtacgttacggaactaacgg

SEQ ID NO: 376336 - DNA, 531 bp, Homo sapiens
  misc_feature: GZ8MTXP02I5KH6.4.81.H04.1.454.CMB.2.raw
  modified_base (374)..(374): a, c, t, g, unknown or other
  modified_base (429)..(429): a, c, t, g, unknown or other
  modified_base (443)..(443): a, c, t, g, unknown or other
  modified_base (463)..(463): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggtttccttgttgctattttagaaggtgtccagtgtgaggtgcacctggtggagtcgtgggggaggcctggtcaaaccgtggggggtccctgagactctcgtgtgtagtctctgaattcatcttcagggtactttgacatgaattgggtccgccaggctccgaggggaaggggctggagtgggtctcatccatcagttccagtacctcgttacatatactacgcngactcagtgaggggcatcacatctcagagacaagccaaagaactcagtgtttacngacaaaatgaaacngacagagagtacgagctcgntcgtactactagtgagacgaaggaaagtaaggactaaccgtaaccgtagtacttaggaacacgagtcg

SEQ ID NO: 376337 - DNA, 562 bp, Homo sapiens
  misc_feature: GZ8MTXP02IU2TM.4.81.H04.1.454.CMB.2.raw
  modified_base (372)..(372): a, c, t, g, unknown or other
  modified_base (400)..(400): a, c, t, g, unknown or other
  modified_base (471)..(471): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatcttcagggactttgacatgaattggtccgccaggctccgagggaaggggcgtggagtgggtctcatccatcagtccagtaccctcgttacatatactacgcngactcagtgacggggcattcaccatccnccagacgaacaaccgcaaagactcagttgtttcctagacaaatgaaactcgcctagagagtcgaggtaccncgggcttcgtactacgtctggtacgacgtaagggaaataagggggactccgtaaccccgtaggtacgtttacggacccaagtacgtaacgg

SEQ ID NO: 376338 - DNA, 678 bp, Homo sapiens
  misc_feature: GZ8MTXP02F2CTL.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctatttagaaggtgtccagtgtgaggtgcactggtggagtcgtgggggaggcctggtcaaaccgtgggggtccctgagactctcgtgtgtagtctctgaattcattcttcgagggtactttgactatgtaagttgggtcccgcgagggcctccggaaggggaaggggcgtgggaggtggggtctcactccatcgtacgttccctagttacctacgttaacaattataactcgacaacgtactcgagggtacggaacgggggtccgtaacttccaaacccgtatacctaccgaagaacgaaccaaaccgaaccaaaggaaactcgtaaagttcgtttactacgaactaaaagttacgaaacacgaccgtaggacgtaacggtaccggaacggacgttaccggcttacggttaccttacgtaaccgttggtacggaccggtaaagggtaaaaggtaaaacggggtacgtaacccgttaacccgtaacggtttaagtttacggaaccgtaaacgg

SEQ ID NO: 376339 - DNA, 542 bp, Homo sapiens
  misc_feature: GZ8MTXP02JFVZA.4.81.H04.1.454.CMB.2.raw
  modified_base (444)..(444): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatcttcagggtactttgacatgaattgggtccgcaggctccgaggggaaggggctgggaggtgggtctcatccatcagttccccagtactcgttacatatactcgcagactcagtggacggggccattccacatctaccagagaccaacgaccaaagactcaagttgtttacngacaaatgaaacagcctgagacgtcggagactcggctgtctactctgtcgacgaggaaagtaaggggactacgtacccgtagtacgtttacgactacg

SEQ ID NO: 376340 - DNA, 607 bp, Homo sapiens
  misc_feature: GZ8MTXP02IRW0K.4.81.H04.1.454.CMB.2.raw
  modified_base (372)..(372): a, c, t, g, unknown or other
  modified_base (475)..(475): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactgggctccgctgggttttcctgttgctatttagaaggtgtccagtgtgaggtgcacctggtggagtcgtgggggaggcctggtcaaaccgtgggggtccctgagactctcgtgtgtagtctctgaattcatcttcgagggtactttggacatgtaagttgggtccgccaggctaccgaggggaagggcgtggagtgggtctcgtatcctatcgagttccccagtactcgttanatactactcgcagactcagtgacggggccattcgacctatcgtccagacgaccaacgacccaaagacctgtaagttcgtttacaggtacaaagtacggaaacngtacccgtagacgtaaggttccgaaggtactcgggtctagttacctacttaaccggttgtacggtacggtaaaggaacggtaaaggggtacacccgttaaccccggtagtacgtttacgggaaacctaacgg

SEQ ID NO: 376341 - DNA, 592 bp, Homo sapiens
  misc_feature: GZ8MTXP02HM4CN.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtccaaaccgtggggggtccctgagactctcgtgtgtagtctctgaattcatcttcgagggtactttgactatgaattgggtccgccaggctccgaggggaaggggcgtgggaggtgggtctcatccatcagttcccagtactcgttacatatactacgcagactcgagtggaaggggccattccactatctccagacgacaacgaccaaagaacctcgtagttcgttttcaggtacctaaagtcgaaaccagcccgtagaaggtagtccggaagggaccgtcgggacttaggttacctacgttacgtggtacgacggaaaggtaagtaaaggggctaccgtaacccgttagtagtttacggactaacg

SEQ ID NO: 376342 - DNA, 642 bp, Homo sapiens
  misc_feature: GZ8MTXP02ISOVR.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgcttattttagaaggtgtccagtgtgaggtgcacctggtggagtcgtgggggagccgtggtcaaaccgtggggggtccctgagactctcgtgtgtagtctctgaattcatcttcgagggtactttgactatagtaagttcgggtccgccgaggtccgtaccggaaggggaaggggcgtgggaggtggggtctcactccatctacgttcccagtacctcgttacattaactactacgcaacactcaggtggacggggcctattccaaccactctaccaagacgaccaaaccgacaaacgactcacgttgtttaccagtaactaaagtacgaaacacgtccctaggaacgtacggtaacggacgggtactccggggtacttcggtacctaacgttacgtggttcggaaggaacggggtaaaagtaacggggacgtaccttaaccccggttaaattacggtttaacgggaacctaacgg

SEQ ID NO: 376343 - DNA, 608 bp, Homo sapiens
  misc_feature: GZ8MTXP02JEZ1J.4.81.H04.1.454.CMB.2.raw
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtggggggtccctgagactctcgtgtgtagtctctgaattcattcttcaggggtactttgactatgtaagttcggggtccgccgaggcctccggaaggggaaggggcgtagggaggtggggtctcactccatcagttccagtacctcgttacatactactacgcagactcgaggtggacggggcctattccaacctactcctaccgaagacgaaccaaacgcccaaagtaactcgtagttcgtttacagaactaaagtagaacacgccgtaggacgagtacggaggaccgtcggtctacgtacctacgtacgtggtacgacggaaggtaaaacgtaacgggactaaccgtaccgtacgtacgttaggactacgagtacgg

SEQ ID NO: 376344 - DNA, 694 bp, Homo sapiens
  misc_feature: GZ8MTXP02JG6U9.4.81.H04.1.454.CMB.2.raw
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatctcaggtacttgacatgaattgggtccgccaggctccgaggggaggggcgtggaggtgggtctcatccatccagttccagtaccctcgtacatactactacgcagactcaggtcgagggggccgtattccaacccgtatccctacccgaagaacggaaaccaaaccggacccaaaaggtaaacccttccgaaaggttccgttttaccgtacggtaacctaaaaattcggaaaaccacgtacccgttaggaaacgacgggttacccggaaaggggtcccttaccgggggtcttacggtaccttaacccgttaccggtcggttaggtaccggaaaggggtaaaaccgttaagggggacctaacccggttaacccccgttaagggtacgttttacggggaaacccgtaccgtaagggttaaacccgg

SEQ ID NO: 376345 - DNA, 574 bp, Homo sapiens
  misc_feature: GZ8MTXP02J2IUM.4.81.H04.1.454.CMB.2.raw
  modified_base (309)..(309): a, c, t, g, unknown or other
  modified_base (455)..(455): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtggggggtccctgagactctcgtgtgtagtctctgaattcatcttcgagggtactttgactatgaagttggggtccnccgaggcctccggaaggggaaggggctggggaggtgggtctcactccatcagttcccagtactcgtacatactactcgcacgactcgagtcggaggggccattcaccactctaccagagacaacgacaaacgactctagttcttcngacaaatcgaaacagccgtagacggtagtcggaaggacgtcggtctgtctacgttacgtgtcggaacgtaaggtaaagtaagggtacaccgtaaccgtagtacgtttacggactaacgg

SEQ ID NO: 376346 - DNA, 542 bp, Homo sapiens
  misc_feature: GZ8MTXP02I806K.4.81.H04.1.454.CMB.2.raw
  modified_base (303)..(303): a, c, t, g, unknown or other
  modified_base (430)..(430): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttcctgttgctattttagaaggtgtccagtgtgaggtgcacctggtggagtcgtgggggaggcctggtcaaaccgtgggggtccctgagactctcgtgtgtagtctctgaattcatcttcgagggactttgacatgaattgggtccncaggctccgaggggaaggggctgggagtgggtctcgatccatcagttcccagtactcgtacatatactacgcagactcagtgacggggcatcacatctcagagacaacgcaaagactcagtgtttcngacaaatgaaacacgcgtagagacggtcggaaggacgtcgggactggtacctactagtcggtagacgtaaggaaagtaaggcgacctacccgtagtactttacggactaacg

SEQ ID NO: 376347 - DNA, 652 bp, Homo sapiens
  misc_feature: GZ8MTXP02GEKAH.4.81.H04.1.454.CMB.2.raw
  modified_base (351)..(351): a, c, t, g, unknown or other
  modified_base (429)..(429): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaacgtggggctccgcttgggttttccttgttgcttattttagaaggtgtccagtgtggaggtgcacgtggtggagtcgtgggggagctggtacaaccggtgggggtccctgagactctcgtgtgtagtctctagtaattcatcttcgagggtactttgactatagtaagttcgggtccgcaggcctccggaggggacggggcgtaggaggtgggtctnactccatcagtacctagtacccttacgtacatactactacgacagactcaggtcggacggggacctattaccaacctntccctacccgaagaacgaacccgaaacgacccaaaggtaacctacgagtttcgtttactcgaaactaaaagtcgaaaacgtacgaccgtaaggaaggacggtacggtaacggaccgtaccggcttacggtacttaccgttagtcggtaggaaacgaagggtaaaagtacggggaactaaccgttaaacccgtagttaacgttcggaaactactacgggtaacg

SEQ ID NO: 376348 - DNA, 758 bp, Homo sapiens
  misc_feature: GZ8MTXP02GEQC4.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctatttagaaggtgtccagtgtgaggtgcactggtggagtcgtgggggagcctggtcaaacgtgggggtccctgagactctcgtgtgtagtctctgaattcatctcgagggtactttgacatagtaagttcgggtccgcacgggccgtccgaaggggaaggggcgtgggaggttgggtctcgactccgatcgtacgttccccgaagttaccttacgttaactattaaattaacctacggcaagtaacctacgaaggtaggaacgggggccctaaatttcccaacctaaacttccctacccgaaagaaacggaacccaaaaccgaaccccgtaaaagaaaaccctccgtaaaacggttttggttttacaacggtaaccgtaaaaattacgggaaaaaccgtaaccgggtcccttaagggaaaccgggttaacggtaccggggaaaacggggttacccgtaccccggggttacgtttacccggtttaaacctttaacgttacggttacgggtaacggaaacggggtaaaaggtaaaacgggtaaacggggactaccccgttaaaacccgtaggttaacgttaacggaactaagg

SEQ ID NO: 376349 - DNA, 594 bp, Homo sapiens
  misc_feature: GZ8MTXP02GO3NJ.4.81.H04.1.454.CMB.2.raw
  modified_base (396)..(396): a, c, t, g, unknown or other
  modified_base (435)..(435): a, c, t, g, unknown or other
  modified_base (440)..(440): a, c, t, g, unknown or other
  modified_base (476)..(476): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtggggggtccctggagactctcgtgtgtagtctctgaattcatcttcagggactttgactatgaagttcgggtccgccaggctccgagggaaggggctgggaggtgggtctcagtccatctacgttcccagtacctcgttacatactactacgcagactcgagngaggggccattcacatcaccagagacaacgcaaagaacnagttnttactgaacaaagtgaaacacgtcctaggagtacgngtaaacggtcgacgggtctggtcctaacgtcgtaggttcgaaccggtaaagggtaaacgttaaagggggacgtacccgttaaaacccgtacggtaacgtttacggggaactaaaacgg

SEQ ID NO: 376350 - DNA, 618 bp, Homo sapiens
  misc_feature: GZ8MTXP02I2PY6.4.81.H04.1.454.CMB.2.raw
  modified_base (381)..(381): a, c, t, g, unknown or other
  modified_base (419)..(419): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatcttcgagggtactttgacatgtaagttgggtcccgccgaggctccgaaggggaaggggcgtggagtgggtctcatccatcacgttccccagtactcgtacatactacncgcagactcgagtggaggggccattcacatccacaganacaacgacaagactctaagttcgtttacagaactaaacgtagaaaacgtaccgaccgtaggaacgtacggtaccggaaacggtcgtaccggggcttacggtacctaacgtacttacgggtgaaacgggaaaggtaaacgtaaacgggggtacaacccgtttaaccccgtaaaggttaccgtttagggaaaccctaacgg

SEQ ID NO: 376351 - DNA, 708 bp, Homo sapiens
  misc_feature: GZ8MTXP02GIBQ9.4.81.H04.1.454.CMB.2.raw
  modified_base (298)..(298): a, c, t, g, unknown or other
tcagagcactgtagcacgaccggtgctcgatttagtagtgtagattcgcggggtctgagagaggagccttagccctggattcccaaggcctatccacttggtgatcagcactgagcaccgaggattcaccatggaactgggctccgctgggttttccttgtgctatttagaaggtgtccagtgtgaggtgcacctggtggagtcgtgggggagcctggtcaaaccgtgggggtccctgagactctcgtgtgtagtctctgaattcatcttcagggactttgactatgaattgggtccnccaggctccgaggggaagggctggagtgggctcatccatcagttccagtacctcgttacatactactacgcagactacgtaggtcgtaagggggcccctaatttacccgaaccctaatcccttacccgaaaggacggaacccaaaaccgacccctaaaaggaacttaccgtaagttcgttttccctaggacctaaaaagtggaaaaccctaggacccgttaggagaacgggttcccggaagggtaacccttcgggggcccttaggggttacccgttaaaaccttaccggttgggttacggaaccggggtaaacggggtaaaacggttaaaagggggaacgtaaccccgttaaacccccggttaaaacgtagttttaacggggaaaccctaagtaaccgggtttaaacggg

SEQ ID NO: 376352 - DNA, 729 bp, Homo sapiens
  misc_feature: GZ8MTXP02IMDWZ.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacgtggtggagtcgtgggggaggcctggtcaaccgtcgggggtcctgagactctcgtgtgtagtctctgaattcatcttacgagggtactttgactatgtaagttcgggtcccgaccgagggcctaccggaggggaaggggcgtagggaggttgggtctacactcccatcgtagttccccagttaccttacgttaactattaacttacctacgacgaacgactacgagggtcgggacgggggtaccctaactttaccgaaccctacgtcctaccgaacgaacgaaaccgaaaccgacccaaaacgaaccgtacgtaaggtttcgtttacgtacgtaacgtaaaagtacgaaaaccgacggacccgttaagggaacggtaacgggttaccggacgggtaaccgttccggggtactcggtttaaccgttaaccttacggtacggttacggaccgggtaaaaggttaaagggtaaaaccggggtacgtaaccccgttaaacccgtaacggtttacggtttacgggaaacctaacgg

SEQ ID NO: 376353 - DNA, 625 bp, Homo sapiens
  misc_feature: GZ8MTXP02GW2SF.4.81.H04.1.454.CMB.2.raw
  modified_base (300)..(300): a, c, t, g, unknown or other
  modified_base (358)..(358): a, c, t, g, unknown or other
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttcctgttgctattttagaaggtgtccagtgtgaggtgcaccgtggtggagtcgtgggggagcctggtcaaaccgtgggggtccctgagactctcgtgtgtagtctctgaattcatctcgagggtactttgacatgaattgggtccnccaggctccggagggagggctggagtgggtctcgatccatcagtccagttcctcgtanatatactacggcagctacgagtacggacgggtcgaacttccaaacctagtccctacgaaaggaacgaaacccgtaaaccgacccaaaacggaaccttccgtaaggtttcgtttacgttacggaactaaaacggttcgaaacacgtacccgtagaggacggtacggaagggtcctacgggcttcggttaactacgttactggtagacggtaaggaaacgtaaggggactaaccgttacccgtagtacgttcggaactacgacgtaacg

SEQ ID NO: 376354 - DNA, 570 bp, Homo sapiens
  misc_feature: GZ8MTXP02JDZLN.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtggggggtccctgagactctcgtgtgtagtctctgaattcatcttcagggtactttgacatgaattgggtccgccaggctcgaggggaaggggctggagtgggtctcatccatcagttcccagtactcgttacatactactcgcagactcgagtgaggggccgattcaccactctaccagaagaccaacgaccaaagtaactcgtaagttcgtttctagaccaaaattaggaaacacgtccgtagaagagtacggaggacgtcggacgtgtactactacgttgtacgacggaaggaaagtaagggataccgtaccgtacgtacgtttcggaactaacg

SEQ ID NO: 376355 - DNA, 732 bp, Homo sapiens
  misc_feature: GZ8MTXP02GX7PT.4.81.H04.1.454.CMB.2.raw
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggagcctggtcaaaccgtggggggtccctgagactctcgtgtgtagtctctgaattcatcttcgagggtactttgactagtgtaagttcgggtccgccgagggtcctacccggaaggggaaggggcgtaggggaggtcggggtctcgactacccgtatccgtagtttccccagttaccttcgttaacaattaacttacctacgcaacggactccgagggttcggacgggggtccctacttcccaaccctactcctaccgaagacgaaacccaacgaacccaaacgtaaaccttcgtaaaggtttcgtttacgaggtaccaaaagttacgaaacgtacgaccgttaggaacgtacggttaccggaagggtaccgttaccgggtacgttcggttaaccgttaaaccgttaccgttagggttacgggaaccggggtaaacgggtaaaaggttaacgggggtaaccgttaacccttaaacccggttaaccggttaaggttttaacggaaccgttaaaccggg

SEQ ID NO: 376356 - DNA, 784 bp, Homo sapiens
  misc_feature: GZ8MTXP02IFE3A.4.81.H04.1.454.CMB.2.raw
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgcttattttagaaggtgtccagtgtgaggtgcacctggtggagtcgtgggggaggcctggtcgaaaccgtgggggtccctgagactctcgtgtgtagtctctgaattcattcttcgagggtactttgacatgtaagttcgggtccgccgaggtcgtccggaaggggaaggggcgtgggtaggtcgggtctcactccgagtctacgttccgagtaccttacgttactatactactacgacacgacctagtaggtagggtacggggcgtacgttaccaacctacttcctacgaacgacgaaaccgaaaccgaccgtaaaacgtaaccttaccgtaagtttcgtttacgtaacgaacgtaaaacgttacggaaaccgtacggtaacccgttagggaaacggtacggggtttaacccgggaacggggttacccgttaccggggtcccgtttaacgtttaccccgtttaacgttaacccggttacggggttaaagggttaaccggggaaaagggggtttaaaacgggtaaaaccggggggttactaacccccgtttaaaacccggttaaaccggtttaaacggttttaaccgggaaccgtaaccggtaaacggggtttaaacccggg

SEQ ID NO: 376357 - DNA, 678 bp, Homo sapiens
  misc_feature: GZ8MTXP02G7K26.4.81.H04.1.454.CMB.2.raw
tcagagcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatctcagggtactttgacatgaagttgggtccgccaggctccgaggggaaggggcgtggagtggggtctcgatccatctagtccagtacctcgttactatatactacgcagactcagtgacggggctagttccaccatcctaccagacgaaccaacgaccgaaacgtaacctacgtacgttcgtttactacggactaaaagttacgaaaacctacggacccgttaggaaacggtaggttaccggaaaggggtccgttacgggtacgttacggttaccgttaaaccgtaccggttacggtaggaccgggtaaaagggtaaaacgttaagggggaaacccttaacccggttaaaccccgttaacggttaacggtttacggggaaaacccttaccggtaagggtttaacccgg

SEQ ID NO: 376358 - DNA, 542 bp, Homo sapiens
  misc_feature: GZ8MTXP02I4RQN.4.81.H04.1.454.CMB.2.raw
  modified_base (384)..(384): a, c, t, g, unknown or other
  modified_base (437)..(437): a, c, t, g, unknown or other
  modified_base (449)..(449): a, c, t, g, unknown or other
  modified_base (487)..(487): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtcgtgggggaggcctggtcaaaccgtgggggtccctgagactctcgtgtgtagtctctgaattcatcttcagggactttgacatgaattgggtccgccaggcctcgaggggaaggggctgggagtgggtctcgactccatcagtccccagtactcgtacatactactacgcagactnagtggaggggccattcaccatctcagacacaacgcaaagactcagtcgtttcngacaaatgaacngcctgagacgtcgaggactcgggactgtactactacgngtcgacgaggaaagtaaggggactaccgtaaccgtacgtaagtttcggaactacg

SEQ ID NO: 376359 - DNA, 594 bp, Homo sapiens
  misc_feature: GZ8MTXP02I9A71.4.81.H04.1.454.CMB.2.raw
  modified_base (421)..(421): a, c, t, g, unknown or other
  modified_base (441)..(441): a, c, t, g, unknown or other
  modified_base (459)..(459): a, c, t, g, unknown or other
tcagagcactgtagcacgaccggtgctcgatttagtagtgtagattcgcggggtctgagagaggagccttagccctggattccaaggcctatccacttggtgatcagcactgagcaccgagattcaccatggaactgggctccgctgggtttccttgttgctattttagaaggtgtccagtgtgaggtgcacctggtggagtcgtgggggaggcctggtcaaaccgtggggggtccctgagactctcgtgtgtagtctctgaattcatcttcagggtactttgacatgaattgggtccgccaggcctccgagggaaggggctggagtgggtctcgatccatctagtccagtacctacgttacattataacttacgcacgactacgagtgagggggccattaccaccctaatcctaccaganaacaacgcccaaagaacctnatgtttactgactaaaanagaacagcagacggaggtacgaggtacgtcggtcttacgtacttacgttagtggtacggacgtaagggtaaaacgtaacggggaactaacccgttaaaccgtaacgttagttaccggaacctacggtaacgtacg

SEQ ID NO: 376360 - DNA, 536 bp, Homo sapiens
  misc_feature: GZ8MTXP02IRO2R.4.81.H04.1.454.CMB.2.raw
  modified_base (301)..(301): a, c, t, g, unknown or other
  modified_base (423)..(423): a, c, t, g, unknown or other
  modified_base (427)..(427): a, c, t, g, unknown or other
  modified_base (431)..(431): a, c, t, g, unknown or other
  modified_base (442)..(442): a, c, t, g, unknown or other
  modified_base (459)..(459): a, c, t, g, unknown or other
tcagagcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttcctgttgctattttagaaggtgtccagtgtgaggtgcacctggtggagtctgggggaggcctggtcaaaccgtgggggtccctgagactctcgtgtgtagtctctgaattcatcttcagggactttgacatgaattgggtccncaggctccgaggggaagggctggagtgggtctcgatccatcagttccccagtactcgttaacatatactcgcagactcagtgaggggccctattcacatctccagagacaacgcaaagactnagtnttcngacaatgaacngcctgagagtcgagacncggtctcgtctactacgtgtcgacgtaaggaaagtaagggacgtaccgtaacccgtagtacgtttacggaactaacg

SEQ ID NO: 376361 - DNA, 346 bp, Homo sapiens
  misc_feature: GZ8MTXP01CKN4T.8.66.F11.1.454.CMB.2.raw
  modified_base (340)..(340): a, c, t, g, unknown or other
  modified_base (345)..(346): a, c, t, g, unknown or other
tcagctcgcgtgtccacgaccggtgctcgatttagtcacgcgagaaggggagcttcccggagaacctgagacaccttaagaacaccatggagaccatagactggaaggtctttgagagctggatgcaccattggctcctgtttgaaatgagcaggcactccttggagacaaaagcccactgacgcctccaccgaaagagtcactggaactggacggacccgtcttcgtgggctggggtgtgaccaagcaggatcgtgggcccagtccccatgtgagagcagcagaggcggtctcatcttcccgcatctgagacacgcgagctgagcgggctggcaaggcnatagnn

SEQ ID NO: 376362 - DNA, 344 bp, Homo sapiens
  misc_feature: GZ8MTXP02HVH4S.8.66.F11.1.454.CMB.2.raw
  modified_base (220)..(220): a, c, t, g, unknown or other
  modified_base (342)..(344): a, c, t, g, unknown or other
tcagctcgcgtgtccacgaccggtgctcgatttagtcacgcgagaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtnttctgggctgggtgtgaccaagcaggatctgggcccagtccccatgtgagagcagcagaggcggtcttcatctccccgccatctgagacacgcgagctgagcgggctggcaaggcgcatagnnn

SEQ ID NO: 376363 - DNA, 346 bp, Homo sapiens
  misc_feature: GZ8MTXP02FG40Q.8.66.F11.1.454.CMB.2.raw
  modified_base (345)..(346): a, c, t, g, unknown or other
tcagctcgcgtgtccacgaccggtgctcgatttagtcacgcgagaaggggagcttcccggagaacctgagacaccttaagaacaccatggagaccatagactggaaggtctttgagagctggatgcaccattggctcctgtttgaaatgagcaggcactccttggagcaaaaagcccactgacgctccaccgaaagagtcactggaactggaggacccgtcttctgggctgggtgtgaccaagcaggatctggggcccagtccccatgtgagagcagcagaggcggtcttcatcttcccgccatctgagacacgcgagctggagcgggctggcaaggcgcatagnn

SEQ ID NO: 376364 - DNA, 584 bp, Homo sapiens
  misc_feature: GZ8MTXP01AH5AX.8.25.C03.1.454.CMB.2.raw
  modified_base (304)..(304): a, c, t, g, unknown or other
  modified_base (580)..(580): a, c, t, g, unknown or other
tcagctcgcgtgtccacgaccggtgctcgatttagtagtgtagatttgggtttgggaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcatctgtgaaaggcagattcaccatctcaagagatgattaccaaaagcatcgccttctaacaaatggacagcctagaaaaccgnggacacaggcgtgtattactgacaactagggttttggtacgggaaatccgacaaaatcgacctgtggggccagggaaaccctggtccaccgtctcctcacgcctccaccacgggcccagtccggtccttcccccgtggccgccctgcctccgacggacgccaccctccgggagacgcaccgacggcccggcccgtcggggctcggccgtcggtacgaacggtaacctaccgttcccgacacggcgagcgttcgaggcgggctgggcacgggctcgngaag

SEQ ID NO: 376365 - DNA, 782 bp, Homo sapiens
  misc_feature: GZ8MTXP01ENTXB.8.25.C03.1.454.CMB.2.raw
  modified_base (357)..(357): a, c, t, g, unknown or other
tcagctcgcgtgtccacgaccggtgctcgatttagtagtgtagatttgggtttggggagctctgggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggagcttggtacagccgagggcgtccctgagactctctgtacagggactggattcattcgtttggtgtactatgcttgtcgaccgtggggtcccgcgaggcctaccggaggggaaggggctgggagtgggtaatctanaagttagaaagtaaagtcttagtcgggtagggaacaacgagtaacgtttaaccggcccgtcggttacgtagggtaaggaaaacggggtccaagggtactttacccaaaccctattaccgtaacgaaaggtaagtaagttacggtaaactttaaccgaaaaaacgtcctaaacgttcccgtaaccctttttaccaaaaccgtaaaagttacggggaacctaaccggtacccgtaaacggaaaaaccccggaggaaaccgaaccggtaagggtacgttaagttaagttaaccgtggttaccgtaaacggttagggggttttacgggttaaaccggggttaaacgttccccggaaagtaaaaacggtccgtaaacccggttccgggtacggggggacccgtaaccgggggttaaccccgttcccgggg

SEQ ID NO: 376366 - DNA, 861 bp, Homo sapiens
  misc_feature: GZ8MTXP01CUKWX.8.25.C03.1.454.CMB.2.raw
  modified_base (281)..(281): a, c, t, g, unknown or other
tcagctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggaggcttggtacagccgagggcggtccctgagactctctgtacgaggactggtattcattcgtttggngtactagtgtctggtcgtaccgtcgggtcccgaccgacggtccgtaccggaagggggaacggggtcgtaggggtacggttaggggtaaacgttctaacgtaagttaaaggaaaaggttaaagtctttaggtgggtacggaaacaaacgaacgtacgttaccggccgtcggtacgtaagggtaacggaacggtctaaaggtaactttacccaaccgtaactttaccgaaacgtaaaaggtacggtaattaacggtaaactttaaacccgaaaaaaggtccttaaacgttcccgttacccttttaacaaacgtaaaagtaccgggaaacctaacggggtaacccgttaaaacggggaaaaaacccggtacgggaaacccaaacggtaacggggttacgttaaacggtttaaaccttaacggttacggaaaccgtaaacgggtttaagggggttttaacggggttaaaccggggtaaaaccttccgtaaaacggtaaaagttccggacccgttacggggtaacgggggacccggtaacgggtaaccccggttcggttacccgtaacccgttcccgttaacccg

SEQ ID NO: 376367 - DNA, 756 bp, Homo sapiens
  misc_feature: GZ8MTXP01CITRM.8.25.C03.1.454.CMB.2.raw
  modified_base (285)..(285): a, c, t, g, unknown or other
tcagctcgcgtgtccacgaccggtgctcgatttagtagtgtagatttgggtttgggggggagaggagccccagccgtgagattcccaggagtttccacttggtgatcagcactgaacacagaccaccaaccatggagtttgggcttacctgggttttccttgttgcttattttaaaaggtgtccagtgtgaggtgcagctgggtggactcgtgggggaggcttggtacagccgagggcggtccctgagactctcctgtacgagggactggtattcattctttggngacttatgctggcgaccgtgggtcccgccgaggcctaccggagggggagggcgtgggaggtgggtaatctacgtattaagaaagtaaagcttagtgggtaggaacaagacgtatacgcgtcgtcgtagtagaacggcaaggtacttccactatctaacgaagagatagtaacttaaccgaaaagtcctaacgttccgtaccctttacaaacgaaaacgttcgggaaacctaacggggtaaccccgttaaacgggaaaaaaccccggagggtaaaccaaccggtaacggggtaccgtttaaaggttaacttaacgtacggtaacgtaaaccgggtttaagggggttttacgggttaaccggggtaaaacttcccggaaaacgtaaaacttcgggacccgttcgggtaaccgggggacccgtaaccgggggtaaccccttggggttaccctaaccccgggttccttaaccccg

SEQ ID NO: 376368 - DNA, 777 bp, Homo sapiens
  misc_feature: GZ8MTXP01APZMW.8.25.C03.1.454.CMB.2.raw
  modified_base (276)..(276): a, c, t, g, unknown or other
  modified_base (287)..(287): a, c, t, g, unknown or other
  modified_base (361)..(361): a, c, t, g, unknown or other
tcagctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggagcttggtacagccagggcgtccctgagactctcctgtacagggactggattcatctttggngactatgctgngaccgtgggtccgcaggctcgaggggaagggctgggagtggggtaatctacgatttagaaagtaaagctttagngggtagggaacaacgagacttacggcccgtacgtctaaggtagaaacggcaaaggtactttccaacctaatccgtaacgaaagtagtaataggaactttaacccgaaaaaagcctaacgttcccgtacccttttaacaaaccctaaaaagttcgggaaccaacggggaccccgttaaagggaaaaaaacccccggaggggtaaacccaaccggaagggggtacccgtttaagggttaaacttttaacccgtaggaaaccgtaaaaccggtttaagggggtttttaacggggtttaaaccggggaaaacttccccggaaaacgtaaaaagttccggttaaacccggttcggtaaccggggggtacccaacgggggtaaccccttcggggttaccctaaccccggtttcctaaccccg

SEQ ID NO: 376369 - DNA, 702 bp, Homo sapiens
  misc_feature: GZ8MTXP01A6OBV.8.25.C03.1.454.CMB.2.raw
  modified_base (280)..(280): a, c, t, g, unknown or other
  modified_base (291)..(291): a, c, t, g, unknown or other
  modified_base (305)..(305): a, c, t, g, unknown or other
tcagctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggaggcttggtacagccgagggcggtccctgagactctcctgtacagggactggattcattctttggngactatgctgngaccgtgggtcccnccaggcctccggaggggacggggctggggagtggggtaagtctacaattaggaaagttaaagtctttagtgggtacgggaacaacgagtacttacggccgtacgtctaggtagaacggcaaggtacttccaacctatcctacaaagtagattagaacttaacccaaaagccaacttccgtaccttttacaaacctaaagtcggaaccaggggaccctaaacggaaaaccggacggaaccacgtagggaccgttagttaacttacgtacgtacgtaacggttaagggttttacgggttaacgggtaaacttcccggaaataaaacgttcgaccgttcgggaacggggaccgtaaccggggtaacccgtcgggttaccctaacccggttcctaaccccg

SEQ ID NO: 376370 - DNA, 770 bp, Homo sapiens
  misc_feature: GZ8MTXP01DHB8I.8.25.C03.1.454.CMB.2.raw
  modified_base (290)..(290): a, c, t, g, unknown or other
  modified_base (473)..(473): a, c, t, g, unknown or other
tcagctcgcgtgtccacgaccggtgctcgatttagtagtgtagatttgggtttgggggggagaggagccccagccgtgagattcccaggagtttccacttggtgatcagcactgaacacagaccaccaaccatggagtttgggcttacctgggttttccttgttgcttattttaaaaggtgtccagtgtgaggtgcagctgggtggactcggtgggggaggcttggtacagccgaggggcggtccctgagactctcctgtacgagggactggtattcattcgttttgggngtacttagtgctggtcgaccgtgggtcccgccgaggcctaccggagggggaacggggcgtggggaggttaggggtaacgtctacgaagttaagaaaggttaaagcgtttagtgggtagggacaaacgacgtacttaccggccgtcgtcgtagtaggaaggcaagtacttaccaaccatcctanaaagagatagaacttaaccaaaagctacgtcctacctttaacaaactaaagtacggaacacggtacccgtaaaacgggaaaaccgacggaaaccaacggtacgggtacgttaaagttaactttaaccgaggtaaacccgtaaagggtttaacgggggttttaacggggttaaaccgggtaaaaccgttcccggaaaactaaaacggttccggttacccggttaccgggtaaccgggggaaacccgtaacccgggggttaaccctcgggttaccctaacccgggttccctaaccccgg

SEQ ID NO: 376371 - DNA, 604 bp, Homo sapiens
  misc_feature: GZ8MTXP02HKODT.8.25.C03.1.454.CMB.2.raw
  modified_base (297)..(297): a, c, t, g, unknown or other
  modified_base (375)..(375): a, c, t, g, unknown or other
  modified_base (379)..(379): a, c, t, g, unknown or other
tcagctcgcgtgtccacgaccggtgctcgatttagtagtgtagatttgggtttgggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggagcttggacagccagggcgtcctgagactctcctgtacagggactggattcattctttggtgactatgctgtgacctgggtccncaggctccgaggggagggctgggagtgggtaagtctcattagaaagtaaagcttaatggtggacaacagattacgcgngtcngtgaaggcaagattcaccatctacaagagatgattaccaaaagcatcgcctttctacaaatggacagcctagaaaaccgagacacgaggcgtagtatactgacaaacgtagggtttacgggttacgggaaaacttccggaaacaaaaacgtcgggtaacccgtcggtaacgggggaccggaaacggggtaccccgtacgggtacccgaacccggttccgtccccg

SEQ ID NO: 376372 - DNA, 604 bp, Homo sapiens
  misc_feature: GZ8MTXP02GUFKI.8.25.C03.1.454.CMB.2.raw
  modified_base (285)..(285): a, c, t, g, unknown or other
  modified_base (345)..(345): a, c, t, g, unknown or other
  modified_base (365)..(365): a, c, t, g, unknown or other
  modified_base (390)..(390): a, c, t, g, unknown or other
tcagctcgcgtgtccacgaccggtgctcgatttagtagtgtagatttgggtttggggagctctgggagaggagccccagccgtgagattcccaggagtttccacttggtgatcagcactgaacacagaccaccaaccatggagtttgggcttacctgggttttccttgttgcttattttaaaaggtgtccagtgtgaggtgcagctggtggactcgtgggggagcttggtacagccagggcggtccctgagactctcctgtacagggactggattcatctttggnactatgctgtgacctgggtccgccaggcctccgaggggaggggctggagtgggtaatctnattagaaagtaaagcttagnggtaggacaacagattacgcgcgtntgtgaaagcaagattcaccatctacaagagatgaacttaccgaaaaagcaacgtcgtacctttactaaacgaaacttggacaacgacctaacgaaaaacccggaggaacaacgaggccgtagtaattactgacaaacgtagggtttcgggttacgggaaacttaccggaacaaaacgtcgaccttacgacgggggaccaacgggaacccctcgg

SEQ ID NO: 376373 - DNA, 1013 bp, Homo sapiens
  misc_feature: GZ8MTXP02J5LD0.8.25.C03.1.454.CMB.2.raw
tcagctcgcgtgtccacgaccggtgctcgatttagtagtgtagatttgggtttgggaggcttggtacagccagggcggtccctgagactctcctgtacagggactggattcatctttggtgactatgctgtgacctgggtccgccaggctccaggaagggctggagtgggtaagtctcattagaagtaaagcttatggtgggacaacagattacgccgcgtctgtgaaaggcagattcaccatctcaagagatgattaccaaaagcatcgccttctacaaagtgacgagcctagaaaccgaaggacgacgaacggtcgtcggttattaacttcgtacgccgtaaaccggtttaggggttttacggtttttaccggggaaaagttaacccggtaccgaaactaaaccctcggggtaccccgtcgggtaaccggggttacccggtaacccgggggtaaaccccggttccgggtttacccgtacccccgggttaccccgttacccgtttaaaccccccgtaccccgtaccccgtaaccccggtaacccccgtaaacccgggtaaccccgggttaccccggttaccccgggtttacccccggggtttcccccgggttacccccgggttcccccgggttccccgggttccccggttacccccgggttaccccgggtaacccgggtaaccccgggtaaaccccgggtaaccccgggtaaccccgggtaaccccggtaacccgggtaacccgggaacccgggaccccggggtaccccggggtaccccggggtaccccgggggttaccccgggggttacccggggttacccggggttacccggggttaacccggggtttaaacccgggttaaacccgggttaaacccggttaaacccggttaaaccccggttaaccccggtaacccggtaacccgggtaaccgggtaccggggtaaccggggtaccggggtaccggggtaccgggtaccggggtaccgggtaaccgggtaaccggtaacgg

SEQ ID NO: 376374 - DNA, 592 bp, Homo sapiens
  misc_feature: GZ8MTXP02JCOJ2.8.25.C03.1.454.CMB.2.raw
  modified_base (355)..(355): a, c, t, g, unknown or other
  modified_base (402)..(402): a, c, t, g, unknown or other
  modified_base (490)..(490): a, c, t, g, unknown or other
tcagctcgcgtgtccacgaccggtgctcgatttagtagtgtagatttgggtttgggggagaggagccccagccgtgagattcccaggagtttccacttggtgatcagcactgaacacagaccaccaaccatggagtttgggcttacctgggttttccttgttgctattttaaaaggtgtccagtgtaaggtgcagctggtggactctgggggagcttggtacagccagggcggtccctgagactctcctgtacagggactggattcatctttggtgactatgctgtgacctgggtccgccaggctccgagggaaggggctggagtgggtaagtctcattagaagtaaagcttaanggtggacaaacagacttacgccgcgtctgtgaaaggcagattcaccntctcaaagagatgattaccaaaagcatcgcctttcacaaaatggaaccagacctagaaaaccgaggacaacgaagggctgtaattacnggacaacgtaggtttcggttacgggaaaatccgacaaaaattcgaacccttcgtacgggggccaacgggggaaacccctgggtaccaccggttctcctaccg

SEQ ID NO: 376375 - DNA, 854 bp, Homo sapiens
  misc_feature: GZ8MTXP02FQ8EU.8.25.C03.1.454.CMB.2.raw
  modified_base (281)..(281): a, c, t, g, unknown or other
  modified_base (307)..(307): a, c, t, g, unknown or other
tcagctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactcgtggggggaggcttggtacagccagggccggtccctgagactctcctgtacagggactggattcattctttggngactatgctgtcgaccgtgggtcccnccaggctccgaggggagggctgggagtggggtaatctacaagttaaggaaagttaaagtcgtttaagtggggtagggaaacaaacgtaggtaacgtttaaccggccccggtacggttcttagggtaaggaaacgggggtccaaaggtaacttttaccccaaaccccttaagtttccctaaccgaaaagggtaagtaaatttaagggtaaactttaaaccccgaaaaaaaggtccctaaacgtttacccggtacccctttttaacgaaaacctaaaagttacggggaaaccctaaacggaccccgttaaacgaaaaaaaccccgggacgggaaaacccaaaccggtaggggtaccggttaggtttaaactttaccgtaggtaacctaaaaccgggttaggggtttttaccggggttaaacgggggtaaaacttcccgggaaaactaaaaacggttacgtaccccggttaacgggtcgggggaacccccgtaaacgggggtaaacccccgttcggggttacccgtaacccccggttaccgttacccccg

SEQ ID NO: 376376 - DNA, 693 bp, Homo sapiens
  misc_feature: GZ8MTXP02HX4BY.8.25.C03.1.454.CMB.2.raw
  modified_base (304)..(304): a, c, t, g, unknown or other
  modified_base (382)..(382): a, c, t, g, unknown or other
tcagctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggagcttggtacagccgagggcgtcctgagactctcctgtacgagggactggattcattcgtttggtgactatgctgtcgaccgtgggtccnccgaggcctaccggaggggaaggggctggggaggtgggtaaagttctactaagttaaggaaaagttaaagtcttaagngggtagggaacaaagagtacttacgccgtgttctaggtagaaggcaagtcttccaacatctacagagatgtaactaaccgaaaagcactccgtacctttacaacgaaatcggaacacggaacgttaacgaaaaccggaggaaacctaacggacggtacgttacgtaagtttaccgacggaacttaaaacgggttaggggtttttcggggtaaaaccggtaaaactcccggaaaataaaacgtccgtacccgtaggtaaccgggggaaccgaacggggtaaccccttacgggtaccttacccgttacacccg

SEQ ID NO: 376377 - DNA, 726 bp, Homo sapiens
  misc_feature: GZ8MTXP02IJ7VA.8.25.C03.1.454.CMB.2.raw
  modified_base (281)..(281): a, c, t, g, unknown or other
  modified_base (308)..(308): a, c, t, g, unknown or other
tcagctcgcgtgtccacgaccggtgctcgatttagtagtgtagatttgggtttggggagctctgggagaggagccccagccgtgagattcccaggagtttccacttggtgatcagcactgaacacagaccaccaaccatggagtttgggcttactgggttttccttgtgctatttaaaggtgtccagtgtgaggtgcagctggtggactcgtggggggagcttggacagccagggcggtccctgagactctcctgtacagggactggattcattctttggngactatgctgtcgaccgtggggtcccncaggcctccgaggggaggggctggggaggttaggggtaatcgtactaagttaaggaaagttaaagtctttagtggggtagggaaccaaacgaggattaccggcccgtcgttctaggtaggaaaaggccaaggtacttaccaacctagtcctaacgaaagaagtaatacgtaacttaaccgaaaacgacaacgttaccgttaccttttaacctaaacgtaaaagttacggaacctacggaaccctaacggaaaaaccggaacggaacgaacggaggtacgtagttaacttaaacgtgaccgtaaacggttaacggggtttacggggttacggggtaaaaacgttcccgaaaacgtaaaaacgttccggtaaaccgttcggggtacgggggacccggtaacggggtaaacccgttacggg

SEQ ID NO: 376378 - DNA, 693 bp, Homo sapiens
  misc_feature: GZ8MTXP02GD9AB.8.25.C03.1.454.CMB.2.raw
  modified_base (279)..(279): a, c, t, g, unknown or other
  modified_base (305)..(305): a, c, t, g, unknown or other
  modified_base (544)..(544): a, c, t, g, unknown or other
tcagctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgcttattttaaaaggtgtccagtgtgaggtgcagctggtggactcgtgggggagcttggtacagccagggcggtccctgagactctcctgtacagggtctggattcattctttggntactatgctgtcgaccgtgggtcccnccaggcctccgaggggacgggctagggagtggggtaactctactagttaaggaagtaaagtcgttagtgggtacggaacaacgagtacttacgccgtacgtcgtaggtaggaacggctaaggtattaccaacctatccgtacaaaggacgtaatacgtaacttaacccgaaaagtctacgtttccgtaccctttacgaaacaaagtccgggaactacgcccgttaaagaaaacccgggngaaccgagaggttactagttaacttacgtacgtacgtaaggtttacggggttacggtaaacggtaaacttaccggaaactaaacgttccggaccgtacgggtaaccggggaccgtaacgggtacccttcggaccctacccgttcacccg

SEQ ID NO: 376379 - DNA, 512 bp, Homo sapiens
  misc_feature: GZ8MTXP01EF18P.11.12.B01.1.454.CMB.2.raw
  modified_base (195)..(195): a, c, t, g, unknown or other
  modified_base (457)..(457): a, c, t, g, unknown or other
  modified_base (480)..(480): a, c, t, g, unknown or other
  modified_base (503)..(503): a, c, t, g, unknown or other
  modified_base (507)..(507): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccaccatcagctgctctggagatgtcttgactaatgagtatgcttcctggtatcagcaagaaggcaggccagccccctgtcctactcatctttacaaaatcccaggccgccctcgtcggggtccctgacgcgattccgtccggctcccgggctcgtagggaaacacagtccactctgaccatcgaggcgggaccaggctattgatgagctgtcttacttctgtcgaggcgtggacaacgagcggtggtggtcgggnggaagggccagtcgttgaccgtnttaggcacgccagcctcgccccngtcncgtcc

SEQ ID NO: 376380 - DNA, 512 bp, Homo sapiens
  misc_feature: GZ8MTXP01EGV7E.11.12.B01.1.454.CMB.2.raw
  modified_base (194)..(194): a, c, t, g, unknown or other
  modified_base (455)..(455): a, c, t, g, unknown or other
  modified_base (478)..(478): a, c, t, g, unknown or other
  modified_base (508)..(508): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccagccccctgtccctactcatctttacaaaatacccgaggccggccctcgtcgggggtccctgacgcgattccgtccggctcccgggctcgtgggaaacacagtcactctgaccatcagcgggaccaggctatgatgagctgtctacttctgtcaggcgtgggacaacgaggcgtgggtgttcgggnggaagggccaggtcttgaccgtnttaggcagcccaggctcgccccttggtccnctcc

SEQ ID NO: 376381 - DNA, 526 bp, Homo sapiens
  misc_feature: GZ8MTXP01A70KE.11.12.B01.1.454.CMB.2.raw
  modified_base (445)..(445): a, c, t, g, unknown or other
  modified_base (463)..(463): a, c, t, g, unknown or other
  modified_base (472)..(472): a, c, t, g, unknown or other
  modified_base (523)..(523): a, c, t, g, unknown or other
tcagcgagagataccacgaccggtgctcgatttagtagtgtagattccgcggggctgggcctcaggaggcagcatcggaggtgcctcagccatggcatggatctctctcttcctcggcgtccttgcttactgcacagaatccatggcctcctatgagttgactcagccaccctccatgtcccgtgtcccccggacagacagccaccatcagctgctctggagatgtcttgactaaatgagtatgcttctggtatcagcagaaggcaggccagccccctgtcctactcatctttacaaaactccgaggccgccctcgtcgggggtccctggacgcgtattccgtcccggctcccgggctcgtgggaaccacagtccacttctgaccatcagccggacccaggctatgatgaggctgtctacttctgtcgaggcgtgggacaacggngtcggtggtcggtcgggnggacggacngttcgtcgtccgttcgttcgcgaacgccgaaggcctccgccccgtcgttcnccg

SEQ ID NO: 376382 - DNA, 520 bp, Homo sapiens
  misc_feature: GZ8MTXP01A7SJZ.11.12.B01.1.454.CMB.2.raw
  modified_base (193)..(193): a, c, t, g, unknown or other
tcagcgagagataccacgaccggtgctcgatttagtagtgtagattccgcgggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggatcagcagaaggcaggccagccccctgtcctatcatctttcaaaatccaggcggccctctggggtccctgacgcgattctcccggctcccgggctcgtgggaaacacagtcactctgacccatcagcgggacccgaggactattgatgaggctgtctacgttctgtcaggcgtggacgaacagcgtggtggtcggcgggcgggacgacgtcgttcgtacgtcgttacggttcgacgaaccgacgcgtccgtccccgttccgtccgttcgtc

SEQ ID NO: 376383 - DNA, 507 bp, Homo sapiens
  misc_feature: GZ8MTXP01C5FDB.11.12.B01.1.454.CMB.2.raw
  modified_base (193)..(193): a, c, t, g, unknown or other
  modified_base (464)..(464): a, c, t, g, unknown or other
  modified_base (501)..(501): a, c, t, g, unknown or other
tcagcgagagataccacgaccggtgctcgatttagtagtgtagattccgcgggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccacgccccctgtcctactcatctttacaaataccaggcgcctcgtggggtccctgacgcgattctcccggctcccgggctcgtaggggaaccacagtcactctcgaccatcagcggacccaggctattgatgagctgtctacttctgtcaggcgtggacaacgagcgtgggtggttcgggcgggaaggtccgagtcngaccgtcgttagcagcccaaggctcgccccttggtcncgtccg

SEQ ID NO: 376384 - DNA, 578 bp, Homo sapiens
  misc_feature: GZ8MTXP01CIDBC.11.12.B01.1.454.CMB.2.raw
  modified_base (194)..(194): a, c, t, g, unknown or other
  modified_base (221)..(221): a, c, t, g, unknown or other
  modified_base (248)..(248): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtcttgactaatgagtatgcttccnggtatcagcagaaggcaggccacgccccctgtcccctactctacttctttacaaaacttacccgaggccggcccttcgtcgggggtcccctggaccgcgtacttcgtcccggctcccgggctcgtacgggaaacacacgtcactctacgacccatcacggccggacccaggcttatgagtgaggtctgtcttacgtttcgtgtcgaggcggtacggacaacgaggcggtgggtcggtccgggcgggaacgggccttaggtcttcggtaccgttcgttagggttccacggtcccgaagggcctccggccccttcggtcccaacgttccccg

SEQ ID NO: 376385 - DNA, 552 bp, Homo sapiens
  misc_feature: GZ8MTXP01DC5AI.11.12.B01.1.454.CMB.2.raw
  modified_base (487)..(487): a, c, t, g, unknown or other
  modified_base (509)..(509): a, c, t, g, unknown or other
  modified_base (516)..(516): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatgtccgtgtccccggacagacagccaccatcagctgctctggagatgtcttgactaatgagtatgcttcctggtatcagcagaaggcaggcccacgccccctgtccctactcattctttacaaaactccacggccccgcccctcgtcgggggtccctggaacgcgtaacgttcccgtcccgggccttcccgggcttaccgtgggggaaacccacgagtccacgtctgacccatccgagccgggacccaggcttatgagtgaggctgtctcttctgtcaggtcgtgggacaacgngtcggttggtcgttcgggcggngggaccnggttcgtgaccgtgttaggcacgcccgaaggtcccg

SEQ ID NO: 376386 - DNA, 508 bp, Homo sapiens
  misc_feature: GZ8MTXP01E0N31.11.12.B01.1.454.CMB.2.raw
  modified_base (194)..(194): a, c, t, g, unknown or other
  modified_base (504)..(504): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccagccccctgtcctactcatctttacaaaatccaggcggccctctggggtccctgacgcgattctccggctccgggctcgtgggaacacagtcactctgaccatcagcgggacccaggctattgatgaggctgtctacttctgtcagggcgtgggacaacagcggtggtggttcgggcgggaagggccaggtcttgaccgtcttaggttcagcccaggcctcgccccgttcggtcnctcg

SEQ ID NO: 376387 - DNA, 513 bp, Homo sapiens
  misc_feature: GZ8MTXP01CWYV4.11.12.B01.1.454.CMB.2.raw
  modified_base (195)..(195): a, c, t, g, unknown or other
  modified_base (451)..(451): a, c, t, g, unknown or other
  modified_base (466)..(466): a, c, t, g, unknown or other
  modified_base (474)..(474): a, c, t, g, unknown or other
  modified_base (505)..(505): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtgtcccccgganagacagccacatcagctgctctggagatgtcttgactaatgagtatgcttcctggtatcagcagaaggcaggccagccccctgtccctactcatcttacaaaatacccaggccggccctcgtggggtccctggacgcgtattcgtcccggctcccgggctcgtgggaacacagtccactctgaccatcgagcgggacccaggctatgatgagctgtctacttctgtcaggcgtgggacacgaggcgtggtgtcggnggtaagggccagtcngtaccgtnttaggttcacgccaggctcgccccttgtccncgttcccg

SEQ ID NO: 376388 - DNA, 515 bp, Homo sapiens
  misc_feature: GZ8MTXP01BGC3I.11.12.B01.1.454.CMB.2.raw
  modified_base (196)..(196): a, c, t, g, unknown or other
  modified_base (454)..(454): a, c, t, g, unknown or other
  modified_base (463)..(463): a, c, t, g, unknown or other
  modified_base (467)..(467): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtgtccccccgganagacagccaccatcagctgctctggagatgtcttgactaatgagtatgcttctggatcagcaagaaggcaggccacgccccctgtccctactcattctttacaaaatcccaggccggccctcgtcggggtccctgacgcgattccgccggctcccgggctcgtgggaacacacgtcactctcgaccatcaggccggaccaggctatgatgagtctgtctacgttctgtcgaggcgtggacagagcgtggtcgtcgggnggaagggcngtcngaccgtgttacggcacgcccaggcctccgccccgttggtccttcgtcc

SEQ ID NO: 376389 - DNA, 517 bp, Homo sapiens
  misc_feature: GZ8MTXP01CIBA7.11.12.B01.1.454.CMB.2.raw
  modified_base (359)..(359): a, c, t, g, unknown or other
  modified_base (462)..(462): a, c, t, g, unknown or other
  modified_base (510)..(510): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttacaaaatccaggccgccctcgtcggggtccctgacgcgattctccggctcccgggctcgtgggaacncagtcactctcgaccatcgagcgggacccaggctattgatgagctgtctacttctgtcaggcgtggacaacgagcgtggtgttcgggcggaagggccaggtcngtaccgtcgttacggttcacgcccgaaggcctcgccccgttcggtccncgttccg

SEQ ID NO: 376390 - DNA, 535 bp, Homo sapiens
  misc_feature: GZ8MTXP01CFV32.11.12.B01.1.454.CMB.2.raw
  modified_base (194)..(194): a, c, t, g, unknown or other
  modified_base (359)..(359): a, c, t, g, unknown or other
  modified_base (455)..(455): a, c, t, g, unknown or other
  modified_base (527)..(527): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggatcagcagaaggcaggccagccccctgtcctactcatctttacaaataccaggccgccctcgtcggggtccctgacgcgtattcgtccggctcccggctcgtgggaacncagtcactctcgaccatcgacgcgggacccaggtctatgatgagctgtctacgttctggtcagggcgtgggacacgaggcgtgggtggttccgggnggtaaggggccaggtccttggtacccgtgttacggttcacggccccgaaggcctccggccccgttcggtccnccgttccg

SEQ ID NO: 376391 - DNA, 594 bp, Homo sapiens
  misc_feature: GZ8MTXP01C9A7U.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctcatcgtccgtcgtcccccgganagacagccaccatcagctgctcgtggagatgtcttgactaatgagtatgtcttctggatcagcaagaaggcacggccacgcccctgtcctactctattactttacaaaactccgaggccgtcctcgtcggggtccctgacgcgtacttccgccggctccggctcgtacgggaacacgcgtccacgtcacgacctagtccgacggaccgggacccaggtaccttaagttgagtagacggtcttcgttcttactttcgtggttccgagggtcggtacggaacgaacgtagggtcggttgggtcggttcggggcgggtaacgggacgttggtcgttacggtaccgtacgttcggcaccggcccgacggtcccgtccggccccgttcggtccttccgttcccg

SEQ ID NO: 376392 - DNA, 573 bp, Homo sapiens
  misc_feature: GZ8MTXP01CZKJQ.11.12.B01.1.454.CMB.2.raw
  modified_base (248)..(248): a, c, t, g, unknown or other
tcagcgagagataccacgaccggtgctcgatttagtagtgtagattccgcggggctgggcctcaggaggcagcatcggaggtgcctcagccatggcatggatctctctcttcctcggcgtccttgcttactgcacagaatccatggcctcctatgagttgactcagccaccctccatgtccgtcgtcccccggacagacagccaccatcagctgctctggagatgtcttgactaatgagtatgcttcnggtatcagcagaaggcacggccacgccccctgtccctactcatctttacaaaatccaggccgccctcgtcggggtccctgacgcgtacttccgcccggctcccggctccgtaggggaaaccacgacgtcactctcgaccatcgagccgggacccaggctatgatgagtctgtcgttacttcgtgtcgagggcgtagggacaaacgtggtccggtgggtcggttcgggcgggtacgggacctaggttccgtacggtacccgttcgttacgggccgaacgaccccgaagggtcccgtccggcccccccgttcgggttccctaacccg

SEQ ID NO: 376393 - DNA, 548 bp, Homo sapiens
  misc_feature: GZ8MTXP01DZG7R.11.12.B01.1.454.CMB.2.raw
  modified_base (461)..(461): a, c, t, g, unknown or other
  modified_base (468)..(468): a, c, t, g, unknown or other
  modified_base (482)..(482): a, c, t, g, unknown or other
  modified_base (511)..(511): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccaccatcagctgctctggagatgtcttgactaatgagtatgtcttcctggtatcagcagaggcaggccacgccccctgtcctactctatctttacaaatccacggccccgccctcgtcggggtccctggaacgtcgcttccgtcccggcctcccgggctcgtacggggtaaccacgagtccacgtctcgacccatccgaggccgggacccaggcttagtgagtggaggtctcgtctacttntgtacgnggtcgtggacacgngtcggttggtcgttcgggcggtaggccgngttcgtgtaccgtcgttagcacgtcccgaaggtcccg

SEQ ID NO: 376394 - DNA, 574 bp, Homo sapiens
  misc_feature: GZ8MTXP01B8TY3.11.12.B01.1.454.CMB.2.raw
  modified_base (481)..(481): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccacgccccctgtcctactcatctttacaaaactccgacggccccgccctcgtcgggggtcccctggaacgcgtcttccgtcccgggtcctcccgggctcgtacggggaacacacgtcactctgacccatcgaggccgggacccagggtctattgagtggaggtctgtctacttctgtcaggtcgttggacaacgnggcgttgggtcggttcgggacgggtcgggttacccgttaggttccgtcgggtacccgttcgtttacggggcaccggtccccgaagggtccccg

SEQ ID NO: 376395 - DNA, 581 bp, Homo sapiens
  misc_feature: GZ8MTXP01CDNAH.11.12.B01.1.454.CMB.2.raw
  modified_base (393)..(393): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccaccatcagctgctctggagatgtcttgactaatgagtatgcttctggtatcagcagaaggcaggcccacgccccctgtcctactcatctttacaaaatccaggcccgccctcgtcggggtcccctggaacgcgtaacttccgtcccgggctcccgggcttcgtcgggaaacncagtcactctacgaccaagtccgacgccggggaaccccagggccttaagttgagtggtaggtcttgtcctacgtttctggtccgaggtccgtagggaccaaacgtggcggttggtcggttcgggcggacggggttacccaggttccgtaaggtacccgtcgtttacggcacggtcccgaacggtcccg

SEQ ID NO: 376396 - DNA, 717 bp, Homo sapiens
  misc_feature: GZ8MTXP01CADDR.11.12.B01.1.454.CMB.2.raw
  modified_base (194)..(194): a, c, t, g, unknown or other
  modified_base (286)..(286): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggatcagcagaaggcaggccacgccccctgtccctacnctactctttacaaaactaccgaggccgccctgtcggggtccctgacgcgattcgccggctccgggctcgtagggaaacacagtccacgtctacgaccagtcgacggccgggaaccccgaggtaccgttaagtttcggaagttcggaacggggtccttacgggttacctttaaccgtttcgttacggggttccgaacgggggtccgggttaacggggaaacccgaaacggtaacggggtcccgggttgggggttcgggtttaccgggggccgggggaaacgggggtaaccccgttacgggttacccgttcgggtaaaccccgggtttcgtttaaccggggttccgaacccgggtaacccccggaaaacgggttccccgtaccccgggtcccccccggttccgggttaaccccgttaacccgtttccccccgg

SEQ ID NO: 376397 - DNA, 537 bp, Homo sapiens
  misc_feature: GZ8MTXP01AXCFF.11.12.B01.1.454.CMB.2.raw
  modified_base (212)..(212): a, c, t, g, unknown or other
  modified_base (353)..(353): a, c, t, g, unknown or other
  modified_base (468)..(468): a, c, t, g, unknown or other
  modified_base (485)..(485): a, c, t, g, unknown or other
  modified_base (494)..(494): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcccaccatcagctgctctggagatgtcttgactaatgagtatgtcttcctggtatcagcagaaggcaggccacgccccctgtcctactcatctttacaaatccgaggcccgccctgtcggggtccctgaacgcgnttccgtccggctccgggctcgtacgggaaccacgagtccacgtcctgacccatcgaggccgggacccaggctattgagtgaggctgtctcttcgtgtcgaggtcgtgggacaagngcgttgggtcgttcggnggcgggccnggttctcggaccgttcgttagggcacggcccgaacgggtcccg

SEQ ID NO: 376398 - DNA, 648 bp, Homo sapiens
  misc_feature: GZ8MTXP01EN8TR.11.12.B01.1.454.CMB.2.raw
  modified_base (199)..(199): a, c, t, g, unknown or other
  modified_base (228)..(228): a, c, t, g, unknown or other
  modified_base (422)..(422): a, c, t, g, unknown or other
  modified_base (462)..(462): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtccccccgganacgacacgccaccatcagctgctctgganatgtcttgactaatgagtatgtcttccgtggtatcagacgaaggaacggcacggcccacgtccccctgtccctactctacttactttaaccaaaagtcccgaggtccgcccgttcgtcggggtccctggaccgccgtacttccgcccgtccgtcccgggctcggtacgggaaaccacgtacgtccactccgtanacccatacggacgggtccggaacccgaggtacttagtagngttacggacggtcttcgttaccttcgtttcgtacggtcgacggggtcggtacggaacgtaacgcgggtccggttgggttcgggttacggggcgggaacggaccgttggtaccgttcggtaccgttcgttacggttccacggcccgacggtccctcccggaccccgttcgtaaccttccgttccccg

SEQ ID NO: 376399 - DNA, 579 bp, Homo sapiens
  misc_feature: GZ8MTXP01AFLMO.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagccaccatcagctgctctggagatgtcttgactaatgagtatgtcttcgtggtatcagcagaaggcaggcccacgccccctgtcctactcattctttacaaaactaccgaggccgccctcgtcggggccctgacgctattccgccggctccggctcgtacgggaacacagtccactctacgaccatcgacggccgggaccaggtactagttgagtggacgtcttcgttcttacgttcgtgtcgagggtcggtggacaacgagtcggtggtcggttcgggcgggaacgggaccgaggtccttacgggtacccgttcgttacggttccgaccggaacccgtaggccgttccccgccccgttcggtaaccttcgtttccccg

SEQ ID NO: 376400 - DNA, 707 bp, Homo sapiens
  misc_feature: GZ8MTXP01DHW4R.11.12.B01.1.454.CMB.2.raw
  modified_base (348)..(348): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtccccggacagacagccaccatcagctgctctggagatgtcttgactaatgagtatgcttcctggtatcagcagaagcaggccagccccctgtcctactcatctttacaaaatccaggccgccctcgtggggtccctgaacgcgtnttcctccgggcctccggcctcgtacgggaaacactagtccaacgtctcgaacccaagtccgaacggcccggggaaccccaggggtacccttaagtttcggaaagtttcggggaacggggtcctttagggttaccctttaacccgtttcccgttggtttacccggaaacgggggtccggggttacgggggaacccaaaacccgggtaagggtcccggggtttgggggttacggttttcccgggggaccgggggtaacggggaaccccggttaggttccccggttaacgggtaacccccggtttggttttaaccggggtaccgttaacccgggtaacccccgaaaaccggggttcccccgg

SEQ ID NO: 376401 - DNA, 595 bp, Homo sapiens
  misc_feature: GZ8MTXP01ESECB.11.12.B01.1.454.CMB.2.raw
  modified_base (195)..(195): a, c, t, g, unknown or other
  modified_base (222)..(222): a, c, t, g, unknown or other
  modified_base (371)..(371): a, c, t, g, unknown or other
  modified_base (471)..(471): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccaccatcagctgctctgganatgtcttgactaatgagtatgcttctggatcagcagaggcaggcccacgccccctgtccctactcatctttacaaaatcccgaggccgccctcgtcggggtccctggaccgcgtacttccgtccggcctcccggctcgtacgggaaacncacgtccactctacgaccagtccgacggccgggacccagggtacttagttgagtgacggtctagttcttacgttcgtgtcgaggcggtagggaactaagnggtcggtgggttcggttccgggcgggaacgggtaccgttggtccgttcggtacccgttcgttacgggttccacggccccgaagggtcccttcccggccccgttcggtccttaaccgtttccccg

SEQ ID NO: 376402 - DNA, 517 bp, Homo sapiens
  misc_feature: GZ8MTXP01BUMOS.11.12.B01.1.454.CMB.2.raw
  modified_base (354)..(354): a, c, t, g, unknown or other
  modified_base (422)..(422): a, c, t, g, unknown or other
  modified_base (483)..(483): a, c, t, g, unknown or other
tcagcgagagataccacgaccggtgctcgatttagtagtgtagattccgcgggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttctggtatcagcagaaggcaggccacgccccctgtccctactcatctttacaaaataccaggccccgccctcgtcgggggtccctgaacgcgnttcctcccgggctcccgggctcgtgggaacacagtcactctgaccatcagcgggacccaggctattgntgaggctgtctacttctgtcgaggcgtagggacagaagcgttggtgttcggcggaggccgngttctgcgtcgtggtccgacgtccgaacgtcccg

SEQ ID NO: 376403 - DNA, 538 bp, Homo sapiens
  misc_feature: GZ8MTXP01A6M7B.11.12.B01.1.454.CMB.2.raw
  modified_base (352)..(352): a, c, t, g, unknown or other
  modified_base (446)..(446): a, c, t, g, unknown or other
  modified_base (462)..(462): a, c, t, g, unknown or other
  modified_base (494)..(494): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccacgccccctgtcctactcatcttacaaaatccaggccccgcctcgtcggggtccctgaacgcgtnttccgtccggctccgggctcgtagggaacacagtcactctagaccatcgacggcgggacccaggctattgagtgaggtctgtctcgtctgtcgnggtcgtgggactacgngtcggttggtggttcgggcgggacgggaccgnggttcctggaccgttcgtacgggtcacgcccgttaagggtcccg

SEQ ID NO: 376404 - DNA, 528 bp, Homo sapiens
  misc_feature: GZ8MTXP01A3QOT.11.12.B01.1.454.CMB.2.raw
  modified_base (239)..(239): a, c, t, g, unknown or other
  modified_base (447)..(447): a, c, t, g, unknown or other
  modified_base (488)..(488): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctgganatgtcttgactaatgagtatgcttcctggtatcagcagaaggcaggccacgccccctgtcctactcatctttacaaaatccacggccgccctcgtcgggggtccctgaacgcgtcttcgtcccgggcctccgggctcgtggggaaccacgagtcactctgaccatcagcgggacccaggctattcgagtcgaggctgtctctctgtcnggcgtagggacacgaagcgttggtgttcgggcggagggccnggttctggaccgtcgttacggcacggtcccgaaggtcccg

SEQ ID NO: 376405 - DNA, 564 bp, Homo sapiens
  misc_feature: GZ8MTXP01DSX22.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacacgccaccatcagctgctctggagatgtcttgactaaatgagtatgcttcctggtatcagcagaggcaggccacgccccctgtcctactcattctttacaaaactccgacggtcccgcccctcgtcgggggtcccctggaacgcgtaacttccgtcccgggctcccgggctcgtagggaaccacagtcactctcgaccatcgacgcgggacccaggctattgagttgaggtcttgtctacttcgtgtcgagggtcgtaggaacaacgtaaggtcgttggggtcgttcgggcgggcgggaccttggttactcggaccgttcgttacggcacggtcccgaacggtcccg

SEQ ID NO: 376406 - DNA, 610 bp, Homo sapiens
  misc_feature: GZ8MTXP01DR0MS.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctggagatgtcttgactaatgagtatgcttcctggtatcagcaagaaggcaggccacgccccctgtcctactcattctttacaaaatccgaggccgccctgtcggggtccctgacgcgtattccgccgctcccggctcgtagggaaaccacgacgtcactctacgaccagtcgacggccggacccaggtactagttgatggacgtctgttacttacgttcgtcgtcgagggtcgtacgggaacaacgtaggtccggttaggggtcggttccgggggcgggtaacgggaccgttaggttccgttacggtaacccggttcgtttaacgggccaaccgggcccctaaggggtccccttacccgggccccccgttacgggtcccttaaccggtttccccg

SEQ ID NO: 376407 - DNA, 500 bp, Homo sapiens
  misc_feature: GZ8MTXP01C97FO.11.12.B01.1.454.CMB.2.raw
  modified_base (194)..(194): a, c, t, g, unknown or other
  modified_base (319)..(319): a, c, t, g, unknown or other
  modified_base (446)..(446): a, c, t, g, unknown or other
  modified_base (460)..(460): a, c, t, g, unknown or other
  modified_base (466)..(466): a, c, t, g, unknown or other
  modified_base (495)..(495): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctggagatgtcttgactaatgagtatgcttctggatcagcagaaggcaggccacgcccctgtcctactcattcttacaaaatccgaggccgcctcgtcgggtccngacgcgattcgccgctccggctcgtagggaacacacgtcactcacgacatcgacggccggaccaggctagttgatgacgctgtcttacgttcgtgtcaggcgtacggacagagcggtggtggtcggnggtaaggcagtcgngacgtnttcggcacgccaggctcgcccgttcgtcncgtcc

SEQ ID NO: 376408 - DNA, 550 bp, Homo sapiens
  misc_feature: GZ8MTXP01EGDON.11.12.B01.1.454.CMB.2.raw
  modified_base (195)..(195): a, c, t, g, unknown or other
  modified_base (362)..(362): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccaccatcagctgctctggagatgtcttgactaatgagtatgcttctggtatcagcaagaaggcaggccacgccccctgtccctactcatctttacaaaatccaggcgcctcgtggggtccctgacgcgattcgtccggctcccggctcgtcgggaacacngtcactctgaccatcgacgccgggacccaggtctagttgagtgagctgtcttacgttctgtcgaggcgtagggacaacgagtcggttgggtcggttcgggcgggaacgggaccaggtcgttcggtaccgttcgttacggttcacggcccgaacggcctccggcccccgttcggtccttccgtttcccg

SEQ ID NO: 376409 - DNA, 560 bp, Homo sapiens
  misc_feature: GZ8MTXP01EHYNG.11.12.B01.1.454.CMB.2.raw
  modified_base (196)..(196): a, c, t, g, unknown or other
  modified_base (223)..(223): a, c, t, g, unknown or other
  modified_base (255)..(255): a, c, t, g, unknown or other
  modified_base (446)..(446): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttacttcacagaatccatggcctcctatgagttgactcagccaccctccatgtcccgtgtccccccgganagacagccaccatcagctgctctgganatgtcttgactaatgagtatgcttcctggtancagcagaaggcaggccacgccccctgtccctactcattctttacaaaataccaggccggccctcgtcggggtccctgacgccgattcgcccggctccggctcgtgggaacacgtagtccactctgaccatcagcgggaccaggctattgatggagtctgtcttacttcgtgtcgaggtcggtggacaacgnggcggttgggtacggttcgggcgggaggaaccgtggttcgtcggttaccgttcgttaacgggttcgcgcccgtaaggcctccggccccgtcggttcctcgttccgtttccccgg

SEQ ID NO: 376410 - DNA, 602 bp, Homo sapiens
  misc_feature: GZ8MTXP01EOU0O.11.12.B01.1.454.CMB.2.raw
  modified_base (214)..(214): a, c, t, g, unknown or other
  modified_base (237)..(237): a, c, t, g, unknown or other
  modified_base (359)..(359): a, c, t, g, unknown or other
  modified_base (543)..(543): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgcccaccctccatcgtccgtcgtccccgganagacacgccaccatcagctgctntggatatgtcttgaactaatgagtatgtcttctggtatcagcaagaagcaggcccacgccccctgtccctactctacttactttaacaaaactccgacggcccccgccctgtcggggtcccngaacgtctcttccgtcccgggctccggctacgacgggaaacacgatacactctacaacatacgacggccgggaccaggtctagttgagtggagtcctgtcttacgttctaggtacgagggtcggtacgggaacaaacggtgtcgggttgggtcgggttccgggggacgggaacggggttaccgnggttacgtaaccgggtacccgttggttacgggaccgacgggaaccccttaaggtccccg

SEQ ID NO: 376411 - DNA, 560 bp, Homo sapiens
  misc_feature: GZ8MTXP01EN0FA.11.12.B01.1.454.CMB.2.raw
  modified_base (214)..(214): a, c, t, g, unknown or other
  modified_base (437)..(437): a, c, t, g, unknown or other
  modified_base (457)..(457): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacacgccaccatcagctgctctggagatgtcttgactaatgagtatgtcttcctggtatcgagcaggagcaggccacgcccctgtcctactcattcttacaaactccacggcccgccctcgtcggggtccctgaacgcgtcttccgtcccggctccggctcgtcgggaaacacgagtccactctacgaccatcgacggccgggaccaggctagttgagtgnggtctgtctacttgtgtcgngggtccgtagggacacggaaggtcggttgggtcggttcggggcgggtagggacccgttggttccgtggtacccgttgttacggcgacggcccgaaggtccccg

SEQ ID NO: 376412 - DNA, 560 bp, Homo sapiens
  misc_feature: GZ8MTXP01DCY48.11.12.B01.1.454.CMB.2.raw
  modified_base (193)..(193): a, c, t, g, unknown or other
  modified_base (220)..(220): a, c, t, g, unknown or other
  modified_base (551)..(551): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccacctccatgtccgtgtcccccgganagacagccaccatcagctgctctgganatgtctgactaatgagtatgcttctggtatcagcaagaaggcaggccacgccccctgtccctactctattctttacaaaatcccgaggccggtccctcgtcggggtccctggacgcgtattccgtcccggcctcccgggctcgtagggaaaccacgacgtccactcgtacgaccatcgacggccgggacccaggctatgatgagtctgtctacgttcgtgtcgaggcgtggacacgaggtcggtggtcggttcgggcgggaagggaccgttaggtcgttcggtaccgttcgttacggttcacggcccaaggcctccgccccgttcggtccnccgttcccg

SEQ ID NO: 376413 - DNA, 588 bp, Homo sapiens
  misc_feature: GZ8MTXP01AOMTX.11.12.B01.1.454.CMB.2.raw
  modified_base (195)..(195): a, c, t, g, unknown or other
  modified_base (222)..(222): a, c, t, g, unknown or other
  modified_base (472)..(472): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccaccatcagctgctctgganatgtcttgactaatgagtatgtcttctggtatcagcagaaggcaggccacgccccctgtccctactctattctttaacaaaactcccgaggccgcccttcgtcggggtccctgaccgcgtattccgcccggctcccgggctcgtagggaaaccacgacgtcactctacgacccagtaccgacgggccgggacccaggtactagtgagtggagtctgttcctacgttcgtgtcgagggcgtaggacaacgnggtcggtggtcggtcgggcgggtaacggccgttaggtccgttcggtaccggttcgttacgggccgaacggtcccgacgggtccctcccggccccgttcggtccttccgtttccccg

SEQ ID NO: 376414 - DNA, 574 bp, Homo sapiens
  misc_feature: GZ8MTXP01EA23D.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccaccatcagctgctctggagatgtcttgactaatgagtatgcttctggtatcagcagaggcaggccacgccccctgtcctactcatcttacaaatccaggcccgccctcgtcggggtccctgaacgcgtctcgtcccggctccggctcgtacggggaacacgacgtccacgtctacgacccacgtccgacggccgggacccacgggctagttcgagtggacggtctcgtcttacttctgtcgcggtcgtacgggacacgaaggtcggttgggtcggttcgggacgggtacgggaccgttggttccgtaacggtaccgttcgttacgggtaccgacggtccccgaagggtccccg

SEQ ID NO: 376415 - DNA, 565 bp, Homo sapiens
  misc_feature: GZ8MTXP01ALUFP.11.12.B01.1.454.CMB.2.raw
  modified_base (215)..(215): a, c, t, g, unknown or other
  modified_base (242)..(242): a, c, t, g, unknown or other
  modified_base (353)..(353): a, c, t, g, unknown or other
  modified_base (384)..(384): a, c, t, g, unknown or other
  modified_base (483)..(483): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatgtcccgtcgtcccccgganagacagccaccatcagctgctctgganatgtcttgactaatgagtatgcttctggtatcagcaggaagcaggccacgccccctgtcctactcatcttacaaatccgaggcccgccctgtcggggtccctgaacgcgtnttccgtccgggctccggctcgtgggaaaccncagtccactcgtgacccatcgaggcccgggaccaggtcttagttgacgtggaggtctcgttactacgttctaggtccgagggtccgtacgggacaacgnggtcggttgggtcggttcgggcgggtaggggacccttggttccgtcgtaccgttgttacgggcacggtcccgaacggtcccg

SEQ ID NO: 376416 - DNA, 607 bp, Homo sapiens
  misc_feature: GZ8MTXP01D4EYQ.11.12.B01.1.454.CMB.2.raw
  modified_base (197)..(197): a, c, t, g, unknown or other
  modified_base (360)..(360): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtgtcccccgganacgacacgccaccatcagctgctctggatatgtcttgactaatgatatgtcttctggtatcagcaagaggcaggccacgcccctgtcctactctatctttacaaatcccaggccgcctcgtcgggtcctgacgcgtatcgtccgctcccgctcgtgggaaacncgtacgtccactctacgaccatacgacggacggaccagggacttagtgagtcggaggtctgttaccttacgttcgtcggtcgaggtcggttacggaaccgaacgacggtccggtggggttcggttccggggcggggtaacgggtcccttaagggtccgttacggttacccgttcggtttaaacgccgaaccggtccccgaaacggtcccgttcccggacccccttcggtcccttaaccgtttccccg

SEQ ID NO: 376417 - DNA, 690 bp, Homo sapiens
  misc_feature: GZ8MTXP01BW0RX.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgccacctccatcgtccgtcgtccccgganagacacgccacatcagctgctcgtggagtatgttcttagaacttaagtgagttatcgtcttcgtggtactcgagcgaaggaacggcacggccacgccccctgtccctactctattaccgtttaacaaaactaccgacgggcccgtcccgttcggtcgggggtccctggaccgtcgtactttcccggcccggtccgtcccgggcttcggacgggaaacaccgtagtccacttcacgacctacgaccggacggacccgggaacccgtaggtacgttaagttgacgttggacggttcttacgttcctttacggttcgttcggtacggacgggtcgggtacggaacgaacggtacgggtcggttggggtcggttccgggggcgggtaacggggtaccttacgggttccgttacggttaccggttcgttacgggttccaccggtaacccgaacgggtccccttccccgggccccgttcggttcccttaaccgtttccccg

SEQ ID NO: 376418 - DNA, 546 bp, Homo sapiens
  misc_feature: GZ8MTXP01ANA91.11.12.B01.1.454.CMB.2.raw
  modified_base (195)..(195): a, c, t, g, unknown or other
  modified_base (222)..(222): a, c, t, g, unknown or other
  modified_base (479)..(479): a, c, t, g, unknown or other
  modified_base (538)..(538): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccaccatcagctgctctgganatgtcttgactaatgagtatgcttctggatcagcagagcaggccacgcccctgtcctactctatctttacaaaatacccgaggccgccctcgtcgggggtcccctggaccgcgtacgttccgtcccggctcccgggctcgtacggggaaacctacgacgtcactctacgacccatcgacggccgggacccaggtctatgactgagtctgtcttacgttctgtcgagggcgtgggacagacggcgtgggtcgtcgggnggaaggcagtcgttacggccgtcttcggcacggcccaggcctccgccccgttggtcccncgttcccg

SEQ ID NO: 376419 - DNA, 590 bp, Homo sapiens
  misc_feature: GZ8MTXP01AYZC3.11.12.B01.1.454.CMB.2.raw
  modified_base (194)..(194): a, c, t, g, unknown or other
  modified_base (220)..(220): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctgganatgtcttgactaatgagtatgcttctggatcagcagaaggcacggccacgccccctgtcctactcacttctttacaaaactccgaggccgccctcgtcggggtccctgacgcgtattccgccggctccggctcgtgggaaccacagtccactcacgaccatcgacggccgggacccgagggtactagttgagtcggaggtcttcgttactacgtttcgtggtcgacgggtcggtagggacaacgaggtcggttgggtcggttcgggcgggaagggtacccttaggtccgttcggtaccggttcgttacggccgaccggtcccgaacgggtcccgtcccggtcccccgttcgggtcccttcccgtttcccg

SEQ ID NO: 376420 - DNA, 570 bp, Homo sapiens
  misc_feature: GZ8MTXP01EJ5J6.11.12.B01.1.454.CMB.2.raw
  modified_base (213)..(213): a, c, t, g, unknown or other
  modified_base (478)..(478): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacacgccaccatcagctgctctggagatgtcttgactaatgagtatgtcttccgtggtatcagcagaaggcaggcccacgccccctgtcctactctatctttacaaatccgaggccccgccctcgtcggggtccctggaacgcgtcttccgtcccgggctccggctcgtacgggaaaccacagtccactctcgaccatcgacggccgggaccaggctagtgagtgaggtctgtctacttcgtgtcgaggtcgtaggacaacgnggtcggttgggtcggttcgggcgggtacgggacccgttaggttccgtcggtacccgttcgttaacgggtccgacggtcccgaacggtccccg

SEQ ID NO: 376421 - DNA, 666 bp, Homo sapiens
  misc_feature: GZ8MTXP01EI329.11.12.B01.1.454.CMB.2.raw
  modified_base (197)..(197): a, c, t, g, unknown or other
  modified_base (263)..(263): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatgtcccgtgtccccccggaanacgacacgccaccatcagctgctcgtggatattgtcttagaactaatgagtatcgtcttctggtancagcgaaggaaggcacggcccaccgccccctgtccctactctacttacttaacaaaactacccgacggccggtcccttcggtcggggtccctggaccgtccgtacgttccgtcccggccgtcccggctcggtacgggaaaccacgtacgtccactctacgacctagtacgacgggccgggaccgaggtacttagttagagtggacgtcgttcgttccgtttacgttcgttcggtcggacgggtcggtacgggaacgaacggtacgggtcggttcgggttacgggttccggggacgggaacgggtaccgttacggtccgttcggtaccggttcggttacggttccgaccggaaccccgtacgggtcccgtccccggtcccccgttccggtcccgttccgttccg

SEQ ID NO: 376422 - DNA, 516 bp, Homo sapiens
  misc_feature: GZ8MTXP01BAINH.11.12.B01.1.454.CMB.2.raw
  modified_base (212)..(212): a, c, t, g, unknown or other
  modified_base (404)..(404): a, c, t, g, unknown or other
  modified_base (450)..(450): a, c, t, g, unknown or other
  modified_base (466)..(466): a, c, t, g, unknown or other
  modified_base (491)..(491): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcaacagaaaggcaggccacgccccctgtcctactcatcttacaaatcaggcgccccctctcggggtccctgacgcgattcgtccggctccgggctctggggaacacagtcactctgaccatcacgcggacccnggctatcgatgggaggtctgtctacttctgtcaggcgtggacacgngtcgtggttggtcggnggtacgggcagttcgttgaaccgtntgggtcaggaccaacggcgtcccgg

SEQ ID NO: 376423 - DNA, 604 bp, Homo sapiens
  misc_feature: GZ8MTXP01EYTBP.11.12.B01.1.454.CMB.2.raw
  modified_base (196)..(196): a, c, t, g, unknown or other
  modified_base (479)..(479): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtgtcccccgganagacagccaccatcagctgctctggagatgtcttgactaatgagtatgcttcctggtatcagcaaggaaggcaggccacgccccctgtccctactcattctttacaaaactcccgaggccggccctcgtcggggtccctggacgcgtattccgccggcctcccgggctcgtagggaaaccacgagtccactctacgacccatcgacggccgggacccagggtaccttagttgagtggacggtcttacgtcttacgttcgtgtcgagggcggtcggactaacgnggtcggtgggttcggttccgggcgggtaacgggtacgttacggtcgttcggtaccgttcgttaacggttccgacggtccccgaaggtcccgtccggtcccccgttcggtcccttaaccgttcccg

SEQ ID NO: 376424 - DNA, 591 bp, Homo sapiens
  misc_feature: GZ8MTXP01EH35B.11.12.B01.1.454.CMB.2.raw
  modified_base (214)..(214): a, c, t, g, unknown or other
  modified_base (417)..(417): a, c, t, g, unknown or other
  modified_base (498)..(498): a, c, t, g, unknown or other
  modified_base (515)..(515): a, c, t, g, unknown or other
  modified_base (535)..(535): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctcatcgtccgtcgtcccccgganagacacgccaccatcagctgctcgtggatatgtcttgactaatgatatgtcttcgtgtactcgagcagaaggcacggcccacgtccccctgtacctactctattacctttaacaaaactccgacggcccccgtccctcggtcggggtccctggaacgccgtcgttccgtcccgggccgtcccggtctacggtacgggaaaccncgacgttcactctacgacctagtcgacggccgggacccaggtctagtgagtggacggtcttgtccttcgttcgtggtacgngggtcggtaggaccagnggtggttggtcggttcgggnggacggcgttgttcgtcggtaccgttcgttacgcgacgtcccgttaacggtccccg

SEQ ID NO: 376425 - DNA, 613 bp, Homo sapiens
  misc_feature: GZ8MTXP01CQ88F.11.12.B01.1.454.CMB.2.raw
  modified_base (197)..(197): a, c, t, g, unknown or other
  modified_base (532)..(532): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtcccgtcgtcccccgganagacagccacatcagctgctcgtggatatgtcttgaactaatgagttatcgtcttccgtggtatcgagcaagaaggcacggccacgccccctgtccctactctacttactttaacaaaacgtcccgacggccggtcccttcggtcggggtccctggaccgtcgtacttccgtcccggcgtcccggcttcgtacgggaaaccacgtacgtacactctacgacacgtcgacggccggacccaggctagtgagtgacgtcttagttcttacgttcgtgtacgacgggtcggtaggacacgacggtcggtgggtcgggtccgggcgggaacgggtacgnggttcgcggtaccgttcgttacggcgaaccggtcccgacggtcccttcccggccccgttccggtccttaacccgtttcccg

SEQ ID NO: 376426 - DNA, 566 bp, Homo sapiens
  misc_feature: GZ8MTXP01DOPDQ.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtcccgtgtcccccgganagacagccaccatcagctgctctggagatgtcttgactaatgagtatgcttcctggtatcagcaagaaggcaggccacgccccctgtccctactcattctttacaaaatacccaggccgccctcgtcggggtccctgacgcgtattcgtccggctcccgggctcgtagggaaacacagtccactctcgaccatcacgcgggaccaggctattgatgagctgtcttacttctgtcgaggcgtggacaacgacggtcggtgggtggttccggggcgggtaacgggaccgaggtcgttcggtaaccgttcgttacgggttccacggcccgaaggcccgttccgcccccgttcgggtccttaaccgtttccccg

SEQ ID NO: 376427 - DNA, 604 bp, Homo sapiens
  misc_feature: GZ8MTXP01BT92J.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtccgtcgtcccccggacagacagccaccatcagctgctctggagatgtcttgactaatgagtatgtcttctgtatcagcagaggcacggccacgccccctgtccctactctacttcctttacaaaactaccgacggccccggcccctcggtcgggggtccctggaacgcgtcttccgtcccgggcctccggtcctcgtagggaaccacgtacgtcactctcgaccatcgagccgacggacccaggtacttagttggagtggacgggtcttcgttccttacgtttcgtcggtcgagggtccggtaggggaacaaacggtggttcggttgggttcggttcggggcgggacgggccgttaggtccgtcggtaaccgttcgttacgggttccaaccggcccgtaaccggg

SEQ ID NO: 376428 - DNA, 577 bp, Homo sapiens
  misc_feature: GZ8MTXP01CXFSG.11.12.B01.1.454.CMB.2.raw
  modified_base (196)..(196): a, c, t, g, unknown or other
  modified_base (255)..(255): a, c, t, g, unknown or other
  modified_base (368)..(368): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtgtccccccgganagacagccaccatcagctgctctggagatgtcttgactaatgagtatgtcttctggtancagcagaaggcaggccacgccccctgtccctactctatctttacaaatcccgaggccgcctcgtcggggtccctgacgcgtactccgtccggctcccgggctcgtgggaaccncgagtcactctcgaccatccgacggcggaccgaggctagttgagtgagtctagttctacgttctcggtcgagggcggtacgggaacacgacggtcggtggtggttcgggcgggaacgggccgttaggtcgttcggtaaccgtcggttacgggttccacggtaacccgaggtcccgtaccggccccgttcgggtaacccttccgttcccg

SEQ ID NO: 376429 - DNA, 573 bp, Homo sapiens
  misc_feature: GZ8MTXP01CQXJ3.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctggagatgtcttgaactaatgagtatgcttctggatcagcaggaaggcaggccacgccccctgtccctactcattctttacaaaactacccgagggccgcctcgtgggggtccctggacgcacttcgtcccggctccgggctcgtagggaaaccacgagtccactctagacccatcgacgacgggacccagggtacttagttgagtgagtctgttcttacgttctgtcgaggcgtgggacagaggcgtgggtcggttcgggcgggaagggtccgaggtcttcggtaccggttcgttacgggcacggaacccgaacgggtcccgtccgccccgttcggtccgttaaccgttcccg

SEQ ID NO: 376430 - DNA, 580 bp, Homo sapiens
  misc_feature: GZ8MTXP01AXIS8.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtccccccgganagacagccaccatcagctgctctggagatgtcttgactaatgagtatgcttctggtatcagcagaaggcaggccacgccccctgtccctactcattctttacaaaactcccgaggccggtccctcgtcgggggtccctgaccgcgtattccgtcccggctcccgggctcgtacgggaaacacacgtcactctacgacccatcgacggccgggacccaggctattgagtgagtctgtctacttcgtgtcgaggtcgtgggacaacgaggcggtgggtggttcgggcgggaacgggaccaggtcgttcggtaaccgttcgttaacgggttccacggccccgtaagggtcctcccggtcccccgttcgggtccttaacccgttcccg

SEQ ID NO: 376431 - DNA, 564 bp, Homo sapiens
  misc_feature: GZ8MTXP01DWCSM.11.12.B01.1.454.CMB.2.raw
  modified_base (194)..(194): a, c, t, g, unknown or other
tcagcgagagataccacgaccggtgctcgatttagtagtgtagattccgcgggctgggcctcaggaggcagcatcggaggtgcctcagccatggcatggatccctctcttcctcggcgtccttgcttactgcacagaatccatggcctcctatgagttgactcagccaccctccatgtcccgtgtcccccgganagacagccaccatcagctgctctggagatgtcttgactaatgatatgcttcctggtatcagcaagaaggcacggccacgccccctgtcctactcattcttacaaatccgaggcgcctcgtcgggcctgacgcgattcgccggctcccggctcgtgggaaccacgtacgtccactctcgaccatcgacgggccgggacccaggtactagttgagtgaggtctgtcttacgttcgtgtcgagggtcgtaggacaagaggtcggtggtcgtcggggcggaagggccgaggttccgacgtaccggttcgttacggttccacggtcccgaacggtccgtcccggcccccgttacggtcccttaaccgtttccccg

SEQ ID NO: 376432 - DNA, 579 bp, Homo sapiens
  misc_feature: GZ8MTXP01CZDLZ.11.12.B01.1.454.CMB.2.raw
  modified_base (197)..(197): a, c, t, g, unknown or other
  modified_base (224)..(224): a, c, t, g, unknown or other
  modified_base (465)..(465): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtcccgtgtccccccgganagacagccaccatcagctgctctgganatgtcttgactaatgagtatgcttctggtatcagcagaaggcaggccacgccccctgtccctactcattcttacaaaactccaggccggccctcgtcgggggtccctggacgccgtattccgtcccggcctcccgggctcgtgggaaacacagtccactctacgaccatcgacggccgggacccaggctagttgagtggagtctgttccttacgttctgtcgagggcggtagggacaacgnggtcggttgggtcggttcgggcgggaacgggccgaggtcgttcggtaccggttcgttacggttccacggccccgaggtcccgtcccggcccccgttcggtcccaacgtttcccg

SEQ ID NO: 376433 - DNA, 671 bp, Homo sapiens
  misc_feature: GZ8MTXP01A13QV.11.12.B01.1.454.CMB.2.raw
  modified_base (360)..(360): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtcccgtcgtccccccggacacgacacgccaccatcagctgctctggagatgtcttgactaatgagtatgcttcctggtatcagcagaaggcaggccacgcccctgtcctactctatcttacaaatccgacggcccgccctcgtcggggtccctggaacgcgtnttccgtcccgggtccgtcccggctcggtacggggaaacccacgtacgtccaccttcgacggaacccacgtccgaacggcccgggggaaccccaggggtccttaagtttgaaggtcggtaacgggtccttcggttaccttaccttcgttcgggttacccgaacggggtccgggttacggggaacccgaaacggtcgggtcgggtttgggggtcggtttccgggggaccggggaacggggttaacccgttggttacccgtcgggtaacccggttcgttaacgggtcccgaaccggccccgttaacggtccccg

SEQ ID NO: 376434 - DNA, 648 bp, Homo sapiens
  misc_feature: GZ8MTXP01B3MDM.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagccaccatcagctgctctggagatgtcttgactaatgagtatgtcttcctggatcagcaggaaggcacggccacgccccctgtccctactctattctttacaaaactaccgaggccggccctcgtcggggtccctggaccgcgtacttccgcccggctcccgggctcgtagggaaccacgacgtcacgtctacgaccatcgacggccgggacccagggcttaagttcgaagtggacgtcttgttcctacgttcgtggtcgacgggcggtaggaaccgaacgtacgggtcggttggggttacgggttccggggcggggtaacggggaacccttgggttccgttcggtaaaccccggttgtttaacggggttcccgaaccggtaaccccgtaacggggtccccttccccgggtccccccgttcgggtaaccccttcccgttttcccccgg

SEQ ID NO: 376435 - DNA, 575 bp, Homo sapiens
  misc_feature: GZ8MTXP01CV3AV.11.12.B01.1.454.CMB.2.raw
  modified_base (195)..(195): a, c, t, g, unknown or other
  modified_base (500)..(500): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtgtcccccgganagacagccaccatcagctgctctggagatgtcttgactaatgagtatgcttctggtatcagcaaggaaggcaggccacgccccctgtccctactcattcttacaaaatccaggccgcctcgtcggggtccctgacgcgtacttccgtcccggctcccggctcgtacgggaaccacgacgtcactctacgaccatcgacggccgggacccaggcttagtgatgacgtctacgtcttacgttctgttcgaggtcgtagggacaacgaggtcggtgggtacggttcggggcgggtaacgggaacccgnggtcgttcgtaccggttcgttacggttccgacgcccgaggccctccggccccgttcggtcccttaacgttccccg

SEQ ID NO: 376436 - DNA, 560 bp, Homo sapiens
  misc_feature: GZ8MTXP01AZ8L8.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtccccccgganagacagccaccatcagctgctctggagatgtcttgactaatgagtatgcttctggatcagcagaaggcaggccacgccccctgtcctactcatctttacaaatcccgaggccgcctcgtcggggtccctgaccgcgtattccgcccggctcccgggctcgtagggaaccacacgtccactctacgaccatcgacggccgggacccaggtactagtgagtgagctgtctacgttctgtcgaggcgtgggacaacgaggtcggtgggtggtcggggcgggaacgggaccgttaggtccgttcggtaccgttcgttacggttcaccgtcccgacggtcctccggccccgttcggtccttcgttcccg

SEQ ID NO: 376437 - DNA, 559 bp, Homo sapiens
  misc_feature: GZ8MTXP01EVL7W.11.12.B01.1.454.CMB.2.raw
  modified_base (213)..(213): a, c, t, g, unknown or other
  modified_base (240)..(240): a, c, t, g, unknown or other
  modified_base (474)..(474): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccaccatcagctgctctgganatgtcttgactaatgagtatgcttctggtatcagcagaaggcaggccacgccccctgtcctactcatcttacaaaatccaggcccgccctcgtcgggggtccctggaaacgcgtcttccgtcccgggcctcccgggtctcgtacgggaaaccacacgtcactctcgaccatcgacgccgggaccaggctatgagtgaggtctgtctacttcgtgtcgaggtcgtaggacaacgnggtcggttgggtcggttcgggcgggaacgggaccgaggttccgtggaccgttcgttacgggcgacggccccgttaagggtccccg

SEQ ID NO: 376438 - DNA, 635 bp, Homo sapiens
  misc_feature: GZ8MTXP01D7QBY.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctggagtatgttcttagactaatgagtatcgtcttctggtatcgagcaagaaggcacggccacgccccctgtccctactctacttacttacaaaactccgaggccgcccttcgtcggggtccctggaccgcgtacttccgcccgtccgtaacccggctccgtagggaaacctacgacgtccactctacgaccacgtcgacggccggacccgaggtacttagttgagtgacgtcgttacgttaccttcgtttcgtcggtcgacgggtcggtacgggaaccaaggtacgggtcggttgggtcgggttccgggcggggaacgggtaccgcggttcgttcggtaccggtttcgttacggttccgaacggaaccccggtacgtccgtcccggtccccgttcggtcccgttaaccgtttcccg

SEQ ID NO: 376439 - DNA, 559 bp, Homo sapiens
  misc_feature: GZ8MTXP01ENHYO.11.12.B01.1.454.CMB.2.raw
  modified_base (195)..(195): a, c, t, g, unknown or other
  modified_base (436)..(436): a, c, t, g, unknown or other
  modified_base (450)..(450): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccaccatcagctgctctggagattgtcttgactaatgagtatgcttctggatcagcagaaggcaggccagccccctgtcctactcattcttacaaatcccgaggccgccttcgtcggggtccctgacgcgtattcgcccggctccggctcgtgggaaacacacgtcactctagaccctagcgacggcggacccgaggtactagttgagtgacggtctagtctacgttctggtcgngggtcgaggacagnggtcggtggtcggtcgggcggtaacgggacttcggtcgttacggtaccgttacgttacgggttcacggcccgacggtcccgtccgtcccgttccgtccgttccgttccg

SEQ ID NO: 376440 - DNA, 625 bp, Homo sapiens
  misc_feature: GZ8MTXP01AFKSA.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtccccccgganagacagccaccatcagctgctctggagatgtcttgactaatgagtatgtcttctggatcagcagaaggcacggccacgccccctgtcctactctatcctttacaaaactccgaggccgcctcgtcgggtcctgacgcgtattccgtccggctcccggctcgtacgggaaacacgacgtcactctacgaccagtcgacggccgggacccagggtccttagttcggatggacggtcttgttaccttacgttcgtcggttcgacgggtcggtacggggacaaacggcggttcgggtggggttacgggttccggggcggggaacgggtaccgacgggttccgttcgggtacccgtttcgttacgggttccgaaccggccccgaacggtcccgtcccggtcccccgttcgggttcccttaaccgtttccccgg

SEQ ID NO: 376441 - DNA, 679 bp, Homo sapiens
  misc_feature: GZ8MTXP01ADTRS.11.12.B01.1.454.CMB.2.raw
  modified_base (215)..(215): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctggagatgtcttgactaatgagtatgcttcctggtatcagcagaaggcaggccacgccccctgtccctactcattctttacaaaatccacggccccgccctcgtcggggtccctggaacgcgtcttccgtcccgggctccgggctcgtagggaaccactagtccactcctacgacccagtccgacgggcccggggaacccagggtaccttaagtttgaaggttgggaacggtccgttcggttacccttacgttccgttcggtaccgtaggggtccggttaggggaacctaaacggcgggtccgggttgggggttcgggtttaccgggggccgggggtaacgggggttaaccccgttagggtttcccgtaaccggggttaaccccggtttcggttttaaccggggtcccttaaccgggtaacccccgaaggggttccccccgg

SEQ ID NO: 376442 - DNA, 630 bp, Homo sapiens
  misc_feature: GZ8MTXP01A68T1.11.12.B01.1.454.CMB.2.raw
  modified_base (514)..(514): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccaccatcagctgctctggagatgtcttgactaatgagtatgtcttctggtatcagcagaggcaggccacgccccctgtcctactcattcttacaaatccacggcccgccctcgtcggggtccctggaacgcgtcttccgtcccgggcctcccgggcctcggtacggggaacccacgacgtccacgtctacgaccctacgtaccgacgggccgggaacccagggaccttaagttcgaggtcgggaggtcttcgttccttacttccgtgtccgaggtcggtacgggaaccaacggnggtcgggttacggggttcggttccgggggacgggtacggggaccgttaggttcccgttaacgggtacccggttaacgtttaacggggcccttacggccccgttaagggtcccccgg

SEQ ID NO: 376443 - DNA, 603 bp, Homo sapiens
  misc_feature: GZ8MTXP01CKZFA.11.12.B01.1.454.CMB.2.raw
  modified_base (197)..(197): a, c, t, g, unknown or other
  modified_base (493)..(493): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgccacatcagctgctcgtggagtatgtcttagactaatgagtatgcttctggatcagcagaaggcacggccacgccccctgtccctactctacttactttacaaaactcccgacggccggtcctcgtcggggtccctggacgtccgtacttccgtccggtcctcccgggcttcgacgggaaaccacgcgtcactcacgaccacgtcgacggccgggacctaggtacttagtgagtcggtacgtcttcgttcttacgttcgtcggtcgacgggtcggtacggacgaacggnggtcggttgggtcggttcggggcgggaacgggacgcggttcgcggtaccgttcggttacggcgacgcccgtaggtcctcccggtccccgttccgtccgttccgttccccg

SEQ ID NO: 376444 - DNA, 716 bp, Homo sapiens
  misc_feature: GZ8MTXP01EEP1C.11.12.B01.1.454.CMB.2.raw
  modified_base (199)..(199): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtccccccgganacgacacgccaccatcagctgctcgtggagtattgtcttagaacttaagtgagtatcgtcttccgtggtactcgagacgaaggaacggccgacggcccaccgtcccccttcgtaccctactactaactttacctttaaccaaaacgtacccgacggtccgtcccgttcggtccggggtccctggaccgtccgtacgttccgtcccggtcccgtcccgggtctcggtacgggaaacctacgtacgtcacctcgtacgacctactaccggacggccggaccgaggtacttagttcgagtcggtacgtcttcgttaccttacggtttcgtcggtacgtacgggtacggtacgggaacgtaacggtacgggtcgggttcggggttacgggttccggggacggggaacgggtaccgttacggttccgttacggtaccggttacggttacggttcccgaaccggtaaccccggtacggtccccgttcccggtcccccgttccggttaacccttcccgttcccg

SEQ ID NO: 376445 - DNA, 605 bp, Homo sapiens
  misc_feature: GZ8MTXP01CJ9G4.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtgtccccccgganagacagccaccatcagctgctctggagatgtcttgactaatgagtatgcttcctggtatcagcagaaggcaggccacgccccctgtccctactctattctttacaaaactcccgaggccggtcccttcgtcgggggtccctggaccgcgtattccgcccggctcccgggctcgtacggggaaaccacgtacgtccactcgtacgacccatccgacggccgggacccagggcttagttgacgtggacggtctgtcttacgttcgtagtcgaggtcgtcggaacaacgtggcggttggggtcggtccggggcgggaacgggacccttaggtccgttcggtaccggttcgttacggttccgacggtccccgagggtccctcccggtccccgttcggtcccttcccgttcccg

SEQ ID NO: 376446 - DNA, 611 bp, Homo sapiens
  misc_feature: GZ8MTXP01ACQ5L.11.12.B01.1.454.CMB.2.raw
  modified_base (194)..(194): a, c, t, g, unknown or other
  modified_base (357)..(357): a, c, t, g, unknown or other
  modified_base (368)..(368): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctggagatgtcttgactaatgagtatgcttctggatcagcagaaggcaggccacgcccccctgtccctactctacttactttacaaaactcccgacggccgccctcgtcggggtccctgacgcgtattcgcccgcgtcccggntcgtgggaacncacgccactcacgaccagtcgacggcccgggaccagggactagtggacgtggacgtctagtaacttagttagttcggtaccgaggggtcggtggggacacggccgaacggtccaacgttccggtcccgtttaagtcggttccggttacggggaaccgttccggggaaaccttacggttccgttaacccgttcgttaggaaccgttcccgaacggacccccgaaacgggccccctaaacccccg

SEQ ID NO: 376447 - DNA, 583 bp, Homo sapiens
  misc_feature: GZ8MTXP01B8WB9.11.12.B01.1.454.CMB.2.raw
  modified_base (477)..(477): a, c, t, g, unknown or other
  modified_base (497)..(497): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtccgtcgtcccccggacagacagccaccatcagctgctctgggagatgtcttgactaatgagtatgtcttcctggtatcagcagaaggcaggcccacgccccctgtcctactctattctttacaaactccgacggcccgccctcgtcggggtccctggaacgcgtcttccgtcccgggcctcccgggctcgtacgggaaaccacgacgtcactctacgaccacgtcgacgccgggacccaggtctagtgacgtgacggtcttgtcttacttcgtgtcgnggtcggtacgggacaacggnggtcggttgggtcggttcgggacgggcgggaccgttggttccgtcggtaccgttcgttacggtccgacggtcccgaagggtccccg

SEQ ID NO: 376448 - DNA, 678 bp, Homo sapiens
  misc_feature: GZ8MTXP01C7SYZ.11.12.B01.1.454.CMB.2.raw
  modified_base (195)..(195): a, c, t, g, unknown or other
  modified_base (221)..(221): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccacatcagctgctctgganatgtctgactaatgagtatgtctctggtatcagcaagaaggcacggccacgccccctgtcctactctattctttacaaaactacccgaggccggtcccttcggtcggggtccctggaccgcgtacttccgtcccgggtctcccgggacttcgaggggaaaccacgtacgtcctacgtctacgaccagtcgacggccgggaccaggtacttagttcgagtggacggtcttagttcccttacggtttcgttggttaccggaacgggtcgggttacgggaaaccgtaacgtacgggtcgggttcggggttggggttacccggggcgggggaacgggtaccggttaggttcccggttacggtaaccccggtttcggtttacgggccgaacccgggtccccggtaaagggtccccgttcccgggaccccccgttcgggttaacccttcccgttttcccccgg

SEQ ID NO: 376449 - DNA, 595 bp, Homo sapiens
  misc_feature: GZ8MTXP01CM4E7.11.12.B01.1.454.CMB.2.raw
  modified_base (479)..(479): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtccccggacagacagccaccatcagctgctctggagatgtcttgactaatgagtatgtcttcctggtatcagcgaagaacggcacggccacgccccctgtacctactctatctttaacaaactccgacggcccgcctcgtcggggtccctgacgctcgttccgtcccgggcctcccggcgtcgtacgggaaaccacgtgtaccactctcgaccatccgacggccgggaccgagactagttggagtggacggtctcgttacttcttcgtcgtaccgnggtcggtacgggacaacgaacggtcgggttgggttcgggttcgggacggggacgggaccgttggttccgtaaggtacccgttaacgttacgggtaccacggcccgaacggtccccg

SEQ ID NO: 376450 - DNA, 621 bp, Homo sapiens
  misc_feature: GZ8MTXP01AYMI9.11.12.B01.1.454.CMB.2.raw
  modified_base (194)..(194): a, c, t, g, unknown or other
  modified_base (363)..(363): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctggagatgtcttgactaatgagtatgcttcctggtatcagcaagaggcacggccacgcccctgtcctactcatcttacaaactccgaggccgcctcgtcggggtccctgacgcgtattccgtcccggctcccggctcgtagggaaacncacgtcactctacgaccatcgacggccgggacccaggtactagttgacgtgagtctgttccttacgtttcgtcggttcgagggtccggtgggaaccaaacggtcggtccgggttggggtcgggttaccggggcgggggtaacgggtacccgttagggttccgttacgggtaacccgtttcggttaacgggttccaccgggtaaccccgtaaggtccccgttaccccggccccgttcgggtcccttaaccgtttccccg

SEQ ID NO: 376451 - DNA, 746 bp, Homo sapiens
  misc_feature: GZ8MTXP01D35WP.11.12.B01.1.454.CMB.2.raw
  modified_base (241)..(241): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagccaccatcagctgctctgganatgtcttgactaatgagtatgtcttctggtatcagcagaaggcaggccacgcccctgtcctactctacttcttacaaactccgacggccccgccccgtcggtcggggtaccctggaacgtcgtaacgttccgtcccgggtcctcccgggtcttacggtacggggaaaccctacgtacgtacctaccgtcgtaccgaaccctacgtccgaacggacccggggaacccgtacgggtacttaacgttacggtagggttacggtaacgggttcctttacgggttcctttaaccgtttcgtacggttaccggtaacggggtccgggttaacggggtaaaccgaaacgggtaacggggttcccggggttgggggtttacggggttccgggggaccgggggtaacggggttaaccccgttacggggttacccggttaacgggtaaccccggtttaaccggtttaacggggacccggttaaccgggtcccccggttaaaccgggttcccccgg

SEQ ID NO: 376452 - DNA, 621 bp, Homo sapiens
  misc_feature: GZ8MTXP01A1ZGB.11.12.B01.1.454.CMB.2.raw
  modified_base (221)..(221): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctgganatgtcttgactaatgagtatgcttctggtatcagcagaaggcacggccacgccccctgtccctactctatctttacaaactccgacggccgccctgtcggggtccctggaccgcgtattccgtcccggctcccgggctcgtgggaaaccacacgtctactctacgaccatcgacggccgggacccagggtcctagttagagtggacggtcttgttccttacgttcgtggtcgacggggtcgtcgggacaacggtagggtccggttggggtcggttccgggggacgggtaacggggtaaccgttgggttccgttcggtaacccggttcgttaacgggttccaccggtaaccccgagggtcccgttccggccccccgttcggtcccgttaaccgtttcccgg

SEQ ID NO: 376453 - DNA, 555 bp, Homo sapiens
  misc_feature: GZ8MTXP01BQ91G.11.12.B01.1.454.CMB.2.raw
  modified_base (213)..(213): a, c, t, g, unknown or other
  modified_base (240)..(240): a, c, t, g, unknown or other
  modified_base (383)..(383): a, c, t, g, unknown or other
  modified_base (451)..(451): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtgtcccccgganagacagccaccatcagctgctctgganatgtcttgactaatgatatgcttctggtatcagcagaggcaggcccacgccccctgtcctactcattcttacaaaactccgaggcccgccctgtcggggtccctgaacgcgtcttcctccgggctccggctcgtagggaaacncgagtcactctcgaccagtcgacggccgggacccagctagtgagtgaggtctgtctcgttcgtgtcgnggtcgtgggacaacgaaggtcggttgggtcggttcgggcgggacgggaccgttggttccgtaaggtacccgttcgttacgggtccgacggcccgaacggtcccg

SEQ ID NO: 376454 - DNA, 676 bp, Homo sapiens
  misc_feature: GZ8MTXP01C15N4.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatgtccgtcgtccccggacagacacgccaccatcagctgctctggagatgtcttgactaatgagtatgcttctggtatcagcagaggcaggccacgcccctgtcctactcatcttacaaatccgagcccgcctcgtcgggtccctgaacgcgtcgttccgtcccggtcgtccgggtctcgtacgggaaacacctagtaccactacctaaaccgactaccgaacgggacccgggaaccccgacgggtacctaagttgggtaaacgttgggggtaacgggtccttacggttaccttaaccgtttccgtacggtccgtaaacggggtcggttaacgggggaaaccaaacggtaagggtccgggtttacggggttcggggtttccggggacggggtaacgggtacccgttacggttccgttacggtaacccggttacgttaacgggttccgacggttaccccgaacgggttcccgttaaccccggg

SEQ ID NO: 376455 - DNA, 675 bp, Homo sapiens
  misc_feature: GZ8MTXP01BN4PF.11.12.B01.1.454.CMB.2.raw
  modified_base (213)..(213): a, c, t, g, unknown or other
  modified_base (241)..(241): a, c, t, g, unknown or other
  modified_base (370)..(370): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganacgacagccaccatcagctgctctgganatgtcttgactaatgagtatgtcttctggtatcgagcaagaggcaggcccacgccccctgtccctactctacttcctttacaaaactccgaggcccccgtccccgtggtcggggtccctggaacgcgtnttccgtcccggctccggctcgtagggaaccacgagtcctaacgtctacggaaccctacgtccgacggccgggaaccccagggtccttaagttcggaaggtcggtaacgggttccttacgggtttaccttaccgtttcgtacggttaccggaacggggtcccggttagggaaccgaacggaagggttccgggttggggttcgggttccgggggaccggggaacggggttacccgttagggttccggtaacggtacccggtttcgttaccggggtacgaccgggtaacccgttaacgggttcccccg

SEQ ID NO: 376456 - DNA, 657 bp, Homo sapiens
  misc_feature: GZ8MTXP01AUMI9.11.12.B01.1.454.CMB.2.raw
  modified_base (199)..(199): a, c, t, g, unknown or other
  modified_base (228)..(228): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctagtgagttgactcagcccaccctccatcgtccgtcgtccccccgganacgacacgccaccatcagctgctctgganatgtcttagactaatgagtatgtcttcctggatcgagcaaggaacggccacgggtcccacgcccccttgtaccctactctacttactttaacaaaacgtcccgacgggtccggtacccctcggttacgggggtcccctaggaccgccgtacttcccgtcccggcgttcccgggcttcgacgggaaaccatacgtcctactctacgacctataccggacgggccgggaacccagggtaccttagttggacgttaggacggttctgttaccttacgtttcgtaggtccgacggggtccggtagggaaccaacggtcgggtcggttggggttcgggttacggggcgggaacgggacccttaggtccgttacggtccgtacgttacggcgaccgcccgaggtcccgccgtccccgttggtccttccgttcccg

SEQ ID NO: 376457 - DNA, 583 bp, Homo sapiens
  misc_feature: GZ8MTXP01D5XXA.11.12.B01.1.454.CMB.2.raw
  modified_base (212)..(212): a, c, t, g, unknown or other
  modified_base (346)..(346): a, c, t, g, unknown or other
  modified_base (467)..(467): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatgtccgtcgtcccccgganagacagccaccatcagctgctctggagtatgtcttgactaatgagtatgtcttcctggtatcagcagaggcaggcccacgccccctgtcctactcatcttacaaatccgacggcgcccccctgtcggggtcccngaacgcgcttccgtcccggcctcccggctcgtacggggaaacacgtagtccacgtctcgacccagtccgacggccgggacccagggactagttgagtgaggtctcgtctacttcgtggtcngggtcggtagggaccaacggaaggtcggttgggtcgggttcgggcgggggaacgggttacccgttggttccgtggtaccgttcgttacgggccacgggccccgttaagggtccccg

SEQ ID NO: 376458 - DNA, 780 bp, Homo sapiens
  misc_feature: GZ8MTXP01BKNQH.11.12.B01.1.454.CMB.2.raw
  modified_base (215)..(215): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatcgtccgtcgtcccccgganagacacgccaccatcagctgctctggatatgtctgactaatgagtatgtcttctggtactcgagcaggacgcacggcccacgcccctgtccctactctacttactttaacaaaacgtccgacggtcccccgtaccccgtcggtcgggggtcccctggaacgtcccgtaacgttcccgtcccgggtcccgttcccgggtccgttccggtaacggggaaaccctaccgtacgttaccaaccgttcgtaccgaaccctaacgtcccggaacgggcccgggggtaaccccaggggtccttaagtttacgggaacgttcggggtaacgggtcctttacggttacccttaaccgtttccgtcggttaccggtacggggtacccgggttacggggaaaccctaaacggtaacggggttcccgggttggggggtttaccggttaccggggggaaccgggggtaacggggttaccccgttcgggtttacccggttaaccggggttaccccggtttaacggttaaaccgggggtcccgaacccgggtaacccccggttaaccggggttcccccgg

SEQ ID NO: 376459 - DNA, 629 bp, Homo sapiens
  misc_feature: GZ8MTXP01B7H4M.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganacgacagccaccatcagctgctcgtggatatgtcttgacttaatgagtatgtcttcctggtatcagcgaaggaaggcacggcccacgccccctgtccctactctacttacttaacaaactaccgaggccgtccctcggtcggggtccctggaccgtcgtacgtttcccgcccggtcctcccgggtcgttccggtacggggaaaccacgtacgtcccacttccgtacgacccagtccgacgggcccgggaccctagggtacttagttgagtcggacgtcttacgttccttacgttcgtggttccgacgggtcggtacggaacacgtaggtcggtgggttcggtcgggcgggaacgggccgttaggtcgttacggtccgttcgttacggccacggccgtacggtccgtcccgtccccgttcgtccttccgtccg

SEQ ID NO: 376460 - DNA, 652 bp, Homo sapiens
  misc_feature: GZ8MTXP01BYZC7.11.12.B01.1.454.CMB.2.raw
  modified_base (194)..(194): a, c, t, g, unknown or other
  modified_base (221)..(221): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtcttgactaatgagtatgtcttcctggtatcagcagaaggcacggcccacgccccctgtccctactctacttactttaacaaaactcccgagggtcccggtacccttcggtcgggggtcccctggaccgccgtacttcccgtcccggtctcccgggcttccgtacgggaaaccacgtacgtccactctacgaccagtacgacggccggacccaggtcttagttgacgtggacggtcttcggttaccttacgttcgttggttaccgacggggtcggtacgggaacctaacggtacgggtcggttacggggtcggttccggggacggggtaacgggaccttagggtcgttaccggtaccgttcgtttacggccgaccgtcccgaacggtccgtcccggcccccgttcgggtcccttaaccgtttccccgg

SEQ ID NO: 376461 - DNA, 589 bp, Homo sapiens
  misc_feature: GZ8MTXP01A3914.11.12.B01.1.454.CMB.2.raw
  modified_base (194)..(194): a, c, t, g, unknown or other
  modified_base (220)..(220): a, c, t, g, unknown or other
  modified_base (387)..(387): a, c, t, g, unknown or other
  modified_base (552)..(552): a, c, t, g, unknown or other
  modified_base (577)..(577): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctgganatgtcttgactaatgagtatgcttctggtatcagcaagaggcaggccacgccccctgtcctactctatctttacaaactcccgaggccggcccttcgtcggggtccctggaccgcgtacttcgccgcgtcccggctcgtagggaacacacgtcactctacgacctanccgacggccggacccaggacttagttgatggacgtctgtacttcctgtgtcgagggcgtggacaacgtggcggtgggtcggttcggggcgggaacgggtaccagggttccgttacggtacccgggttcgttacgggttccgaccggtaacccggaacgggtcccncccgggtccccccgttcgggttccnccgtttccccgg

SEQ ID NO: 376462 - DNA, 550 bp, Homo sapiens
  misc_feature: GZ8MTXP01BCOQG.11.12.B01.1.454.CMB.2.raw
  modified_base (194)..(194): a, c, t, g, unknown or other
  modified_base (293)..(293): a, c, t, g, unknown or other
  modified_base (354)..(354): a, c, t, g, unknown or other
  modified_base (433)..(433): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttctggtatcagcagaaggcaggccacgccccctgtcctactcatcttanaaaatacaaggcgccctcgtggggtccctgcgcgattcgccggctccggctcgtgggaacncagtcactctgaccatcagcgggacccaggtctagttgatgagtctgtctacttcgtgtcgagggcgtgggacaacggnggtcgtgggtcggtcgggcgggaagggaccgttggtcgttacggtaccgttcgttacggttccacggtaacccggacgggtccctccccgggtccccgttcggtcccttccgttccg

SEQ ID NO: 376463 - DNA, 524 bp, Homo sapiens
  misc_feature: GZ8MTXP01BJ24J.11.12.B01.1.454.CMB.2.raw
  modified_base (194)..(194): a, c, t, g, unknown or other
  modified_base (221)..(221): a, c, t, g, unknown or other
  modified_base (437)..(437): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtcttgactaatgagtatgcttcctggtatcagcagaaggcaggccacgccccctgtccctactcattctttacaaaactccgaggccggccctcgtcggggtccctgaccgcgtattccgtcccggctacccggctcgtgggaacacagtcactctcgaccagtcgagccgggacccaggtactagttgagtgagtctgtctacgttctgtcnggcgtggacacgagcgtggtgtcggcggaaggcagtcgttgccgtcgttagttcacgtccaggctcggccccttcgtcttccgtccg

SEQ ID NO: 376464 - DNA, 532 bp, Homo sapiens
  misc_feature: GZ8MTXP01BMRDS.11.12.B01.1.454.CMB.2.raw
  modified_base (198)..(198): a, c, t, g, unknown or other
  modified_base (256)..(256): a, c, t, g, unknown or other
  modified_base (340)..(340): a, c, t, g, unknown or other
  modified_base (346)..(346): a, c, t, g, unknown or other
  modified_base (352)..(352): a, c, t, g, unknown or other
  modified_base (363)..(363): a, c, t, g, unknown or other
  modified_base (368)..(368): a, c, t, g, unknown or other
  modified_base (443)..(443): a, c, t, g, unknown or other
  modified_base (477)..(477): a, c, t, g, unknown or other
tcagcgagagataccacgaccggtgctcgatttagtagtgtagattccgcgggggctgggcctcaggaggcagcatcggaggtgcctcagccatggcatggatccctctccttcctcggcgtccttgcttactgcacagaatccatggcctcctatgagttgactcagccaccctccatcgtccgtcgtcccccgganagacacgccaccatcagctgctctggagatgtcttgactaatgagtatgcttctggancagcagaacgcacggccacgccccctgtcctactcattcttacaaaatcccgaggccgcctcgtggtcctgacgctatcgcgcncgctgnggaacncacgtcactcncgacngtcacggccggaccaggtcttagtgataggacgcttacgttcttacgttcgtgtacgagggtcgtaggacaacgnggtcgtggggtcgtcgggcggaaggaccaggtcncggtcctcgttaggccacggcccgaggtccctcgccccgttggtccttcgtcccg

SEQ ID NO: 376465 - DNA, 551 bp, Homo sapiens
  misc_feature: GZ8MTXP01C33AP.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccggacagacagccaccatcagctgctctggagatgtcttgactaatgagtatgtcttcctggtatcagcagaaggcaggccacgccccctgtccctactcattcttacaaatacccaggccgcctcgtcgggtccctgacgcgtacttccgtccggctcccggctcgtgggaaaccacgagtccactctacgaccatcgacggccgggacccaggctagttgagtgagcttgtctacgttcgtgtcgagggtcgtgggacacgaggtcggtggtggtcgggcgggaacgggccgagttcgcggtaccgtcgttacggcacggcccaggccgtccgccccgttccggtccttccgttcccg

SEQ ID NO: 376466 - DNA, 619 bp, Homo sapiens
  misc_feature: GZ8MTXP01ERLFX.11.12.B01.1.454.CMB.2.raw
  modified_base (215)..(215): a, c, t, g, unknown or other
  modified_base (256)..(256): a, c, t, g, unknown or other
tcagcgagagataccacgaccggtgctcgatttagtagtgtagattccgcgggctggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctggagatgtcttgactaangagtatgcttcctggtatcgagcagaaggcaggcccacgccccctgtccctactcattcttacaaaactccgacggccgcctgtcggggtccctgacgtcgtattccgcccggctccgggctcgtacgggacacgagtcactctcgaaccatccgacggccgggaccccagggtaccttagttgggaagttcggacgggtccttcggttccttacgtttccgtaggttccgaggggtccggttaggggaaccaaacggtgggttccgggttgggttcgggttccggggacgggttacggggttacccttaggttccgtcggtaacccgttcgttacgggccgtaaccggaaccccgtaacggg

SEQ ID NO: 376467 - DNA, 612 bp, Homo sapiens
  misc_feature: GZ8MTXP01DSPH6.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganacgacagccaccatcagctgctctggagatgtcttagactaatgagtatgtcttctggatcagcaagaaggcacggccacgccccctgtccctactctattactttacaaaactcccgaggccgcctcgtcgggtcctgaccgcgtactccgtccggcctaaccggctcgtacgggaaactacgacgtccactctacgaccactacgacggccggacccgaggtacttaagttgagtagagtctagtcttacgtcgtgtacgaggtcgtagggacaacgagggtcggtgggtcggtcgggcgggaacgggtacccgaggtccgttaggtaccccggtttagttaccgggcgaccgggaaccccggaacggtcccgttccccggcccccgttcgggtaacccttccggtttcccccg

SEQ ID NO: 376468 - DNA, 561 bp, Homo sapiens
  misc_feature: GZ8MTXP01D9U0O.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctggagatgtcttgaactaatgagtatgtcttctggatcagcaagaaggcaggccacgccccctgtcctactcattcttacaaaactccaggccgcctcgtcgggtcctgacgcgtattcgtcccggctcccggctcgtacgggaaacacacgtccactctacgaccatcgaggccgggaccaggtcttatgagtgagctcgttcttacttcgtgtcgagggtcgtagggacaagacggcggtgggtggttcgggcgggaacgggccgttaggtcgttacggaccgttcgttacgggttcacggcccgacggcttcccggccccgttggtcccttcgttcccg

SEQ ID NO: 376469 - DNA, 540 bp, Homo sapiens
  misc_feature: GZ8MTXP01A3FEL.11.12.B01.1.454.CMB.2.raw
  modified_base (193)..(193): a, c, t, g, unknown or other
  modified_base (337)..(337): a, c, t, g, unknown or other
  modified_base (461)..(461): a, c, t, g, unknown or other
  modified_base (533)..(533): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagccaccatcagctgctctggagatgtcttgactaatgagtatgcttctggatcagcaggaaggcaggccacgccccctgtccctactcatctttacaaaatcccaggccgccctcgtcggggtccctgacgcgattccnccggctccgggctcgtgggaaaccacgagtcactctagacctatcgacggccgggacccaggactattgatgacgctgtctacgttctgtcgagggcgtgggacacgagcgtgggtggtcgggngggaacgggccaggtcgcgtaacccgttcgttagggcacggcccgagggcctccggcccccgttacggtccncttcccg

SEQ ID NO: 376470 - DNA, 653 bp, Homo sapiens
  misc_feature: GZ8MTXP01BB7W8.11.12.B01.1.454.CMB.2.raw
  modified_base (215)..(215): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgcccaccctccatcgtccgtcgtccccgganagacagccaccatcagctgctcgtggagtatgtcttagaactaatgagtatgtcttcgtggtatcgagcaaggaacgcacggcccacgccccctgtccctactctacttacttacaaaactccgacggccccgccctcgtcggggtccctggaacgtcgtcgttccgcccggaccgtcccggctacgtagggaacacacgtcactctacgacctacgtcgacggccgggaacccgaggaccttaagtcgtaaggttggacggtccttcggttaccttaccgttcgtggtaccggagggtaccggtagggaaacctaacgggtcgggttcgggttcggggttcgggttaccggggacgggtaacgggttaccgttcggttccgtaacgggtacccggttaacggtacggtccgaccggtaacccgttaaccgggtcccg

SEQ ID NO: 376471 - DNA, 600 bp, Homo sapiens
  misc_feature: GZ8MTXP01DR2V3.11.12.B01.1.454.CMB.2.raw
  modified_base (198)..(198): a, c, t, g, unknown or other
  modified_base (226)..(226): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacacgccaccatcagctgctctgganatgtcttgactaatgagtatgcttctggtatcagcaagaaggcacggccacgccccctgtccctactctattactttacaaaactcccgaggccgtccctcgtcggggtcctgacgcgtacttccgtcccggcctcccggctcgtagggaaaccacgacgtccactctacgaccagtccgacggccgggaacccagggtacttagttggagtggacggtcttcgttccttacgttcgtggtaccgagggtcggtacgggacaacgaggtcggtgggttcggtcgggcgggaacggtccgttagtcgttacgtaccggttcttacggttccacgcccgaggtccgtcccgccccgttccggtccttccgttcccg

SEQ ID NO: 376472 - DNA, 629 bp, Homo sapiens
  misc_feature: GZ8MTXP01BA9BW.11.12.B01.1.454.CMB.2.raw
  modified_base (215)..(215): a, c, t, g, unknown or other
  modified_base (243)..(243): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgccaccatcagctgctctgganatgtcttgactaatgagtatgtcttctggtatcagcaaggacggcacgcccacgcccctgtccctactctacttactttaacaaaactccgacggtccccgtccccgttacgtcgggggtcccctggaacgccgtaacgttcccgtcccgggtccctcccgggcttccgggtacgggaaaccacgtacgtaccactctacgacctacgtcgacggccgggacccagggtctaagtcgagtggacggtctacgtcttacgttcgtcgtacggcggtcggtacggacaacggaaggtcgggttcggttcgggttccgggacgggacgggttacgttcggttacgtaacggtacccgttcggttacggcacggtcccgaacggtccccg

SEQ ID NO: 376473 - DNA, 622 bp, Homo sapiens
  misc_feature: GZ8MTXP01ED405.11.12.B01.1.454.CMB.2.raw
  modified_base (215)..(215): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatcgtccgtcgtcccccgganagacacgccaccatcagctgctcgtggatatgtcttagactaatgagtatcgtccttcgtggtactcgagacgaaggaacggcgacggcccaccgtccccctgtcctactactacttacttaacaaaactccgacggccccgtccgtcggtcggtcctggaacgtcgtcgtccgtcccggccgtcccggcgttacgacgggaaccacgtacgtctaccgtcgacgaacctacgtacgacgggacccgggacccgagtaccttagttgacggtcggtacggtcttcgtcttacgttcgtgtacggaggtcggtaggacgaagcgggtcgttggggtcggttcgggacgggtacggcgttcggttcgtcggtaccgtcgttacggtccgacgtcccgttaaggtccccg

SEQ ID NO: 376474 - DNA, 567 bp, Homo sapiens
  misc_feature: GZ8MTXP01EJED4.11.12.B01.1.454.CMB.2.raw
  modified_base (211)..(211): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacacgccacatcagctgctctggagatgtcttgactaatgagtatcgtcttcctggtatcagcgagaacggcacggccacgccccctgtcctactctatcttacaaatccgacgccgccctgtcggggtcctgaagcgtcttccgtccggccttcccggctcggtacgggaaaccacgacgtacacgtctacgacactcgacggccggaccagtctagtgagtggagtcttgtccttacgttcttcgacgtggcggtacggaacaaggcggtggttgggtcggttcgggacgggacgggcgttacggttccgtcggtaccgttcgttacgggccacggcccgaacgggtccccg

SEQ ID NO: 376475 - DNA, 624 bp, Homo sapiens
  misc_feature: GZ8MTXP01EPLT5.11.12.B01.1.454.CMB.2.raw
  modified_base (214)..(214): a, c, t, g, unknown or other
  modified_base (400)..(400): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctcatcgtccgtcgtcccccgganagacacgccaccatcagctgctcgtggagtatgtcttgactaatgatatgcttcgtggtatcagcaaggaggcacggcccacgcccctgtcctactctacttacttaacaaaactccgacggtccccggcccttcggtcggggtccctgaacgctctccgtccggctccggctcgacgggaacacngtaccactctacgactacgtcgaacgggtccgggaaccgacggtacttagtggtacgtaggtacgggtccttcggttaccttaccgttcgttacgtacggacgggtcgggtacggggaacaacgggtaagggttcgggttggggtcgggttcggggcgggtaacgggccgttcggttaccgtcggtaccggttcgttacggcgacccggtccgaacggtccccg

SEQ ID NO: 376476 - DNA, 533 bp, Homo sapiens
  misc_feature: GZ8MTXP01AXNHR.11.12.B01.1.454.CMB.2.raw
  modified_base (524)..(524): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggatcagcagaaggcaggcccagccccctgtccctactctatctttacaaaatccaggccgcctcgtcggggtccctggacgcgattccgtcccggctcccgggctcgtgggaacacgagtcactctcgaccatcaggcggaccaggctagtgatgagctgtctacgttctgtcgaggtcgtggacaacgagcggtgggtgtcgggcgggaacgggccaggtcgttcgaccgtcgttaggttcacgcccgtaggcctccggtccccgttcggtccnccgttcccg

SEQ ID NO: 376477 - DNA, 605 bp, Homo sapiens
  misc_feature: GZ8MTXP01EE4P7.11.12.B01.1.454.CMB.2.raw
  modified_base (198)..(198): a, c, t, g, unknown or other
  modified_base (383)..(383): a, c, t, g, unknown or other
  modified_base (503)..(503): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganacgacagccaccatcagctgctcgtggatatgtcttgactaatgagtatcgtcttctggatcagcaaggacgcacggccacgcccctgtcctactctacttacttaacaaacgtccgaggccgcccgttcgtcggggtccctgaccgcgtacgtccgccggtcgtcccggctcgtacgggaaacncgacgtcctactctacgaccagtccgacggccggaccaggtactagttgagtgagtcttagtcttacttcgtggtcgagggtcgtaggaacaacggtggtccggtgggtcggttcggggnggtaacgggaccgttcggtcgttacgtaccggttacgttacggccgttaaccgcccgtacgggtccctacccggtccccgttcggtaacccttcgtttcccg

SEQ ID NO: 376478 - DNA, 687 bp, Homo sapiens
  misc_feature: GZ8MTXP01BQMI1.11.12.B01.1.454.CMB.2.raw
  modified_base (239)..(239): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctgganatgtcttgactaatgagtatgcttcctggtatcagcagaaggcaggccacgcccctgtcctactcatctttacaaatccaggcccgccctcgtcggggtccctgaacgcgtcgttcctcccgggcctcccggctcgtagggaaccactacgtccaactccttacgaccctactccgaacggcccgggggaaccccaggggtaccttaagtttcggaaggttcgggtaacggggtccctttcgggttaccctttaacctttcccgttagggttacccgacgggggtacccgggttacgggggaaacccaaaccggtaacggggtcccgggtttgggggttcgggtttccgggggaccggggtaacggggaaccccgttagggttcccgtaacgggtaccccggttcgtttaaccggggtccgaccggaaccccgttaacgggtccccgg

SEQ ID NO: 376479 - DNA, 609 bp, Homo sapiens
  misc_feature: GZ8MTXP01BKR5C.11.12.B01.1.454.CMB.2.raw
  modified_base (195)..(195): a, c, t, g, unknown or other
  modified_base (222)..(222): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccaccatcagctgctctgganatgtcttgactaatgagtatgcttctgatcagcagagcacggccacgccccctgtccctactcattactttacaaaatacgaacggccgtacctcgtcggggtccctgacgcgtattccgccggcctcccggctcggtagggaaccacgacgtccacgtctacgaccatcgacggccgggacccagggtcttagtgagtgaggtctgttcctacgttcgtgtcgacgggtcggtacggaacgaacgaggtcggttcgggttcggttccggggcgggtaacgggtaccgttaggttcccgttcggtaaccgttcgttacgggttccgaccggtaacccgtacgggtcccgtacccggtcccccgttaggtcccttaaccgtttccccg

SEQ ID NO: 376480 - DNA, 717 bp, Homo sapiens
  misc_feature: GZ8MTXP01BNZCZ.11.12.B01.1.454.CMB.2.raw
  modified_base (258)..(258): a, c, t, g, unknown or other
  modified_base (342)..(342): a, c, t, g, unknown or other
  modified_base (401)..(401): a, c, t, g, unknown or other
  modified_base (678)..(678): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcacgccacctccatcgtccgtcgtccccggaagacacgccacatcagctgctcgtggatattgtcttagataatgagttatcgtcttccgtggtancgagacaaggtacggcacggccaccgtcccctgtcctatctattacttaaccaaatcccgaggtccgtacctcggtcgggtccnggaccgtcgtacgtttcccggcccggtccgtttacccgggcttcggtacgggtaaaccnccgtacggttaccaccgttacgtaccggacccttacgtaccggaaccgggaccggggtaacccgtaggttaccgtttaacgttagtaacggtccgggttaacgggttccttacggtttacccctttacgggtttcgtcgggttaaccggacggggttacggtacgggaaccacggtacgggttcgggtcggttacggggccgggacggggtaacggtccgttaggttccgttacggtaccggttcgttacggccgaccgaacccggtccggttcccnccccgggtcccttaccgggtccttaacccggtttccccg

SEQ ID NO: 376481 - DNA, 708 bp, Homo sapiens
  misc_feature: GZ8MTXP01CUNK5.11.12.B01.1.454.CMB.2.raw
  modified_base (215)..(215): a, c, t, g, unknown or other
  modified_base (606)..(606): a, c, t, g, unknown or other
  modified_base (662)..(662): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggactccctctcttcctcggcgtccttgcttactgcacagaatccatggcctcctatgagttgactcacgcccaccctccatcgtccgtcgtccccganagacacgccacatcagctcgctcgtaggtagtattcgtacttaggaacttaaatggagttactcgtcctttccgtaggtactcgagacgaaaggaacggccgacgggccctaccgtccccccttagtacccctacgttactaactttacctttaaacgaaaaaccttaccggaccgggtaccccccggtcccggttacggtcccgggggttacccctaggaaaccgttaccgtaacgtttcccgtccgggtacccgttcccggtccgtacgggtacgggaaacccacgtacgtcctacttccgacgaaccacgtacggaacggcccgggaacctacggtacttagtagtaagtcggtaaggtcttacgttccttacgttcgtcgtaccggnggtacggtagaacccgtagcggtcgggttggttcgggttcgggcggaacgggttcncggttcgtaacgtcgttcgttagccgttacgccgaacggttccccg

SEQ ID NO: 376482 - DNA, 715 bp, Homo sapiens
  misc_feature: GZ8MTXP01CKXVF.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatcgtccgtcgtcccccgganagacacgccacatcagctgctctggagatgtcttgaactaatgagtatcgtcttccgtggtatcagcaaggaaggcacggccacgtccccctgtccctactctacttactttacaaaactcccgacggccggtacccttcgtcgggggtccctaggaccggtccgtacgtttcccgtcccgggtccgttccccgggtcttcggtacggggaaacccacgtacgtccaccgttctacgaacctacgtaccgacgggccgggaaccccgtaggtaccgttagttaggagtacgggacggtcttcgggtttaccttacggtttccgtggttaccggacggggtccggttaacgggaacgtaaacggacggttcggggttcggggtcgggtttcgggggacggggtaacggggtacccgttagggttccgttacggtacccggttacgtttaacgggccgaccggaacccgtaacgggtccctccccgggtcccccgttcggttcccttaacccgtttccccg

SEQ ID NO: 376483 - DNA, 620 bp, Homo sapiens
  misc_feature: GZ8MTXP01DRWTG.11.12.B01.1.454.CMB.2.raw
  modified_base (197)..(197): a, c, t, g, unknown or other
  modified_base (224)..(224): a, c, t, g, unknown or other
  modified_base (367)..(367): a, c, t, g, unknown or other
  modified_base (384)..(384): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctgganatgtcttgactaatgagtatgtcttctggtatcagcaagaaggcaggcccacgccccctgtcctactctatactttacaaaactcccgaggtccgcccttcgtcgggggccctggaccgcgtattccgtccggctacccgggntcgtacgggaaaccacngtcactctcgaccatcgacggccgggacccaggtacctagttgagtggagtcttagttaccttacggttcgttacggtcggacgggtcggtagggaaccgaaggtacgggtcgggttggggttcggttaccggggcggggaacggtaccgttacggtccgttacggtaccgttacgttacgggcaccggtaaccgacggtccgtccccgtccccggttcgtcccttaacgttcccg

SEQ ID NO: 376484 - DNA, 620 bp, Homo sapiens
  misc_feature: GZ8MTXP01BP33T.11.12.B01.1.454.CMB.2.raw
  modified_base (196)..(196): a, c, t, g, unknown or other
  modified_base (224)..(224): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatcgtccgtcgtcccccgganagacacgccaccatcagctgctctggantgtcttagactaatgagtatgtcttcgtggtatcagcgaagaacggcacggccacgccccctgtccctactctattacttacaaaacgtccgacggtccgtcccgttcgtcggggtccctggacgtccgtacttccgtcccggtccgtcccggctcggtacgggaaaccacgacgtcactctcgacctacgtcgacggccgggacccaggtacttagtgagtggacgtcttacgtcttacgttcgtgtcggaggtcggtacggaactagacggtcggtcggggttcggtccgggcggggtaacggaccgttgggtccgttcgggtaccgttcgttacgggttcacggaacccgaggtcccgtcccgtccccggttacgtccgttaaccgtttcccg

SEQ ID NO: 376485 - DNA, 702 bp, Homo sapiens
  misc_feature: GZ8MTXP01A0X2M.11.12.B01.1.454.CMB.2.raw
  modified_base (198)..(198): a, c, t, g, unknown or other
  modified_base (243)..(243): a, c, t, g, unknown or other
  modified_base (254)..(254): a, c, t, g, unknown or other
  modified_base (258)..(258): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtccccccgganagacagccaccatcagctgctctggagatgtcttgactaatgatntgtctctggancagnagagcaggccacgccccctgtcctactctacttactttaacaaaactcccgacggccggtccctcggtcggggtaccctggaccgtcggtacttcccgtcccgggccctcccgggtctccgtacgggaaacccaccgtacgtcctaacttcgtacaaccctataccggaccgggccggggtaaccccagggtaccttagttaggacgtggacgtcttcgttaccttacgttcgtacggttcgacgggtccgtagggacccgaaacgtcgggtccgggttggggttcggtttccgggggccgggaacgggggtaacccttacggggttccgttaccgggtacccggtttacggtttaacgggcccttaaccggggaaccccgtaacggggttccccgttccccgggtccccccgttccggggtaacccttccccggttttccccg

SEQ ID NO: 376486 - DNA, 581 bp, Homo sapiens
  misc_feature: GZ8MTXP01CAQ5A.11.12.B01.1.454.CMB.2.raw
  modified_base (194)..(194): a, c, t, g, unknown or other
  modified_base (248)..(248): a, c, t, g, unknown or other
  modified_base (401)..(401): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttccnggtatcagcagaggcaggccacgccccctgtccctactctattacctttacaaaactcccgaggccggtccccgtcgtcgggggtcccctggaccgcgtactttccgcccggcctcccgggctcgtacgggaacacgacgtcactctcgaccntcgacggcgggacccaggactatgatgagtcttgtcttacgttctgtcgagggcgtggacagaggtcgtgggtcggtcgggcgggtaacgggaccgttaggtcgcgtaacggttccgttaggccgttaccggccccgtaaggcccgtcccggccccgttcggtccgttaaccgttccccg

SEQ ID NO: 376487 - DNA, 625 bp, Homo sapiens
  misc_feature: GZ8MTXP01EVEQ7.11.12.B01.1.454.CMB.2.raw
  modified_base (196)..(196): a, c, t, g, unknown or other
  modified_base (254)..(254): a, c, t, g, unknown or other
  modified_base (259)..(259): a, c, t, g, unknown or other
  modified_base (389)..(389): a, c, t, g, unknown or other
  modified_base (428)..(428): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatcgtccgtcgtcccccgganagacacgcccaccatcagctgctcgtggagatgtcttagactaatgagtatgcttcgnggtancagcgagaacggcacggcccacgccccctgtccctactcacttacttaacaaaacgtccgacggccggtcccttcggtcggggtccctgaccgcgtacttccgccgtccgtcccggctcgacgggaaacnctacgtctactctacgaccagtcgacgggccgggaaccncggtactagttacgagtggacggtcttgtcctttaccggttcgtcggtacggacggggtcggtacggggaacctaacggacgggtcgggttaggggttcgggtccggggagggaacgggtaccttagggtccttacggtaccgttcgttacgggttcacggtccgacgtccgtcccgcccttcggtccttcgttccg

SEQ ID NO: 376488 - DNA, 721 bp, Homo sapiens
  misc_feature: GZ8MTXP01A4RZR.11.12.B01.1.454.CMB.2.raw
  modified_base (198)..(198): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgcccaccctccatcgtccgtcgtcccccgganacgacacgccacatcagctgctcgtggagtatgtcttagaacttaagtgagttatgtcttcgtggatcgagacgaaggaacggccgaacggcccaccgtcccccctgttcccctatacctacgtttacctttaacaaaacgttacccgacgggtcccggtccccgttcggtccgggggtccctaggtaccccgtccggttactttcccggtcccgggtcccgtcccgggtccgttcggaacgggaaacccacgtacgtccctactccgtacgaccctacgtacgaccgggacccggaccgagggtaccttagttaggagtcggtacgtcgttcgttaccttcggttcgtacgggttaccggacgggtccgggttacggaactaaaccggtggggtcggttcggggttcggttaccggggacgggtaacggtacccgttggttcccgttacggtaccgttacggttaccggccgaccgcccggtacgcccgtcccggtccccgttcggtcccttccgttccccg

SEQ ID NO: 376489 - DNA, 604 bp, Homo sapiens
  misc_feature: GZ8MTXP01ETZ4B.11.12.B01.1.454.CMB.2.raw
  modified_base (197)..(197): a, c, t, g, unknown or other
  modified_base (228)..(228): a, c, t, g, unknown or other
  modified_base (260)..(260): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganacgacacgccaccatcagctgctcgtggagntgtcttgactaatgagtatcgtcttctggtancagcaaggaaggcgacggcccacgccccctgtccctactctattacctttaacaaaactcccgaggtccggtcccttcggtcggggtccctggacgccgtattcgtcgtcggcccttccggctcgtacgggaaccacgtacgtccacttcgtacgaccagtccgacggccgggacctaggtcttagtgagtcggaacggtcttcgtacttacgttcgtacggtcgagggtcgtaggacaacgtggtcggtggtcgggtcgggcgggacggccgtaggttcgtcggtacccgttggttcggaccaacggcccgaacggtccgtcccggcccctcggttcctcccg

SEQ ID NO: 376490 - DNA, 637 bp, Homo sapiens
  misc_feature: GZ8MTXP01CM7O9.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctggagatgtcttgactaatgagtatgcttctggtatcagcaagaaggcacggccacgccccctgtccctactctacttctttaacaaaactcccgacggccggtcccttcggtcggggtccctggaccgcgtacttccgtcccggctcccgggctcgagggaaaccacgacgtccactctacgacctatcgacggccggacccaggcttagtgagtgagtctgtcttacgttcgtgtcgacgggtcggtaggaaccaacgtacgggtcggttaggggttcgggttaccggggcggggtaacgggtacccgttagggttccgttacggtaacccggtttcggttaacggttccgaaccgggtaaccccgaacgggtccccgtacccgggtccccccgttcggttaacccgttccgtttccccg

SEQ ID NO: 376491 - DNA, 671 bp, Homo sapiens
  misc_feature: GZ8MTXP01ACB9T.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatcggcctcctatgagttgactcagcccaccctccatgtccgtcgtcccccgganagacacgccacatcagctgctcgtggatatgtcttagactaatgagtatgtcttctggtatcgagcgaggacggcacggcccacgccccctgtccctactctacttactttaacaaaacgtcccgacggccggtccctcggtcggggtccctggtacgtccgtacgttccgtcccggtcctcccgggactccggtagggaaaccacgtacgtccactcgtacgaccataccgacgggccgggtaccaggtacttagtgagtggacgtcttcgttactacggtttcgtcggtacgtacgggcggttacggaacgtaacggcggtcgggttcgggttacgggttccggggacggggaacgggtaccccgttagggttcccggacggttaaccggtcgtttaacgggttccacccgggaacccggtaacgggtccctccccgggtccccgttccggtaacccttcccgtttccccgg

SEQ ID NO: 376492 - DNA, 608 bp, Homo sapiens
  misc_feature: GZ8MTXP01CPJGP.11.12.B01.1.454.CMB.2.raw
  modified_base (196)..(196): a, c, t, g, unknown or other
  modified_base (252)..(252): a, c, t, g, unknown or other
  modified_base (377)..(377): a, c, t, g, unknown or other
  modified_base (389)..(389): a, c, t, g, unknown or other
  modified_base (395)..(396): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccgganagacacgccaccatcagctgctcgtggagatgtcatgactaatgagtatgtcttcnggtatcagcagaagcaggccacgcccctgtcctactctattcttaacaaactccgaggcccgtccgtcggtcggggtcctggacgtcgtacgttcccgcccggccttccggctcgacgggaaccncacgtccactcncgaccnnccgaggcccgggaccaggtcttagtggatggacgtcttcgttacttcttcgtaggccgtaagggtcggtaagggtaccaacggtggtccgggttgggttacggtccgggggaacgggtacgggttaccgtacggttcggtacggtaccgttacggttacggcctaaccggcccgaagggtcccctccggttcccccgttcggttccttcccg

SEQ ID NO: 376493 - DNA, 672 bp, Homo sapiens
  misc_feature: GZ8MTXP01B6C48.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgccacatcagctgctcgtaggagtattgtcttagacttaatgagttatgtcttccgtggtatcagcgaaggaacggcacggccaccgccccctgtaccctactctattaccttaacaaacgtcccgacggtccgtcccgtcggtaccgggtcctaggaccgtcgtacttcccgcccggtcgtacccggcgtcgtacgggaaccactacgtacctactcacgacctagtaccgacggaccggaccaggtacttagtgagtgacgtcttagtaccttacggttgtcggtacggacgggtacgggtacgaacgaaggtcgggtcgggttcggggttacggtccggggaacggggttaaccgggacgttacggttcgttacggttaacccgttcgggtttacggaccgacccgggcccgtaaccggtccgtaccccggtcccccggttacgtaacccgttccgttttccccgg

SEQ ID NO: 376494 - DNA, 567 bp, Homo sapiens
  misc_feature: GZ8MTXP01A7WK1.11.12.B01.1.454.CMB.2.raw
  modified_base (195)..(195): a, c, t, g, unknown or other
  modified_base (222)..(222): a, c, t, g, unknown or other
  modified_base (558)..(558): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctcatgtcccgtgtcccccgganagacagccaccatcagctgctctgganatgtcttgactaatgagtatgcttcctggtatcagcagaagcacggccacgtccccctgtcctactcattactttacaaaacttacccgacggtccggcccttcgtcgggggtcccctggaccgtcgtactttccgtcccggcctaccgggctcgtacggggaaaccacgacgtcaactctacgaccagtccgaggcccggggacccaggactattgagtgacgtctgtctactgtagcgaggcggtggaacacgaggtcggtggtaggtcgggcggaaggcagtcgaggaccgtcgttacgttcgcgccgacgtccgtcccgccccttcggtccncgttcccgg

SEQ ID NO: 376495 - DNA, 663 bp, Homo sapiens
  misc_feature: GZ8MTXP01C95IO.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgcccaccctccatcgtccgtcgtcccccggacacgacacgcccaccatcagctgctcgtggagtatgtcttagactaatgagtatgtcttcgtggtactcagcaaggaaggcacggccccacgccccctcgtacctactacacttactttaacaaactccgacggtccccgtcccgtcgtcggggtccctggaacgtcgtcttccgcccggtcctccgggctcgtacgggaacctactacgtccacgtctacgaccacgtaccgacggtacccgggacccgaggtccttaagtcggaggttcggtacgggttccttacgttccttaccgtttcgtcggttacgcgggtacgggtaccgggacgtaacggtaacgggtcgggttaggggttcgggttccgggggtacgggacggggttaaccgttcggttccgtaacggtaccgttcggttacggacgttacggtccgaaccgggtcccg

SEQ ID NO: 376496 - DNA, 594 bp, Homo sapiens
  misc_feature: GZ8MTXP01D9AD9.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatcgtccgtcgtcccccggacagacacgccaccatcagctgctctggagatgtctgactaatgatatgtcttctggtatcagcagacgcaggccacgcccctgtcctactctatactttacaaatccgacggccccgtcccgtcgtcggggtccctgacgcgtcgttccgtccggcctccggcttcggtacgggaaccacacgtccacgtcacgaacccagtccgacggccgggacccagggcttagttgacggtcggaggtcttcgttccttacgttcgtggtcgacgggtcgtagggacaacggaacgtcggttaggggtcggttcggggcgggttaacgggacccgttgttaccgcgggttaccgtcgtttacgggccacggtcccgaacggggtcccg

SEQ ID NO: 376497 - DNA, 577 bp, Homo sapiens
  misc_feature: GZ8MTXP01DQ3MJ.11.12.B01.1.454.CMB.2.raw
  modified_base (215)..(215): a, c, t, g, unknown or other
  modified_base (458)..(458): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgccaccatcagctgctctggatatgtcttagactaatgagtatgcttctggtatcagcagaaggcaggcccagccccctgtcctactcattcttacaaatccgacggcccgccctgtcggggtccctgaacgcgcttcgtcccgggctccggctcgtagggaccacacgtcactctacgacactcgacggccggaccaggtctagttgagtgaggtctcgtcttacttcgtgtccgnggtcgtcggacgacgtaaggtcggttgggttcggttcgggcgggtacgggttaccgttcggttaccggtcggtaacccgttcggttaacggccgttaccggtcccgttaaccggtcccg

SEQ ID NO: 376498 - DNA, 551 bp, Homo sapiens
  misc_feature: GZ8MTXP01EO3S2.11.12.B01.1.454.CMB.2.raw
  modified_base (195)..(195): a, c, t, g, unknown or other
  modified_base (222)..(222): a, c, t, g, unknown or other
  modified_base (492)..(492): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagccaccctccatcgtccgtcgtcccccgganagacagccaccatcagctgctctgganatgtcttgactaatgagtatgtcttcctggtatcagcaagaaggcaggcccacgccccctgtccctactcacttactttacaaaatcccaggccgccctcgtcggggtccctggacgccgtattccgtcccggccgtcccggctccgtagggaaaccacacgtccactctacgaccatcgacggccgggacccaggtactagttgagtgagctgtcttacgttctgtcgaggcgtggacacgagcgtggtgttcgggcggaacgggaccngtacttcggacgttcgttagttcacgcccaggccctcggccccttcggtccgttctccc

SEQ ID NO: 376499 - DNA, 588 bp, Homo sapiens
  misc_feature: GZ8MTXP01ALA7W.11.12.B01.1.454.CMB.2.raw
  modified_base (212)..(212): a, c, t, g, unknown or other
  modified_base (239)..(239): a, c, t, g, unknown or other
  modified_base (364)..(364): a, c, t, g, unknown or other
  modified_base (543)..(543): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatgcctcctatgattgactcagccaccctccatcgtccgtcgtcccccgganagacagccaccatcagctgctctgganatgtcttgactaatgagtatgtcttctggtatcgagcagaggcaggccacgcccctgtcctactcattcttacaaaactccgacggccccgtcccgtcgtcggggtccctgaacgccgtcttccnccgggtcctccggctcggtacgggaaccacacgtcctactccgtgaacccagtaccgacggcccgggacccaggtctacgttagagttggaacggtcttacgtccttacgttcgtggtacgcggtcggtacggactaacgaaggtcggttgggtcgggttcggcggggtacggacccgngttacgtcggaccgttcgttacggcaccggtccgttaacggcccg

SEQ ID NO: 376500 - DNA, 611 bp, Homo sapiens
  misc_feature: GZ8MTXP01A4QMV.11.12.B01.1.454.CMB.2.raw
  modified_base (601)..(601): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccggacagacacgccaccatcagctgctcgtggagatgtcttgaactaatgagtatcgtcttcgtgtatcagcaaggaggcacggccaccgccccctgtccctactctactactttacaaaactccgacggccgcctcggtcggggtccctggccgcgtctcccgtccggcctcccgggctcgtacgggaacacgtacgtcactcacgaccagtcgacggcccggaccaggtctattgagtgacggtcttgttccttacgttcgtacggtcgacgggtcgggtaggaacacgggtagtcgggttgggtcggtccggggacgggtcgggaccgttacggtccgttcgggtaccgtcgttacgggttccaccggaacccgtacgggtccctcccggtcccccgttagtcccncccgttcccg

SEQ ID NO: 376501 - DNA, 679 bp, Homo sapiens
  misc_feature: GZ8MTXP01CCBBP.11.12.B01.1.454.CMB.2.raw
  modified_base (152)..(152): a, c, t, g, unknown or other
  modified_base (199)..(199): a, c, t, g, unknown or other
  modified_base (230)..(230): a, c, t, g, unknown or other
  modified_base (267)..(267): a, c, t, g, unknown or other
  modified_base (352)..(352): a, c, t, g, unknown or other
tcagcgagagataccacgaccggtgctcgatttagtagtgtagattccgcggggctgggcctcaggaggcagcatcggaggtgcctcagccatggcatggactccctctcttcctcggcgtccttgcttactgcacagaatccatcggcctnatatgagttgactcagcccaccctcatcgtccgtcgtcccccggaanacgacacgccacatcagtctcgctgaggatntgtctagaactagtgtagtctcgtcttacgtagtacncgagacgaggacgcgacgcccgccgtcccctctacctactactacttactaaacaaacgtccgcggccgtccgtcggtccggtcncggacgtcgtcgtcccgtccggtcccgtccgggtcgtaccggtaaacggaacctaccgtactacctacgtccacgtaccgtacgaccggaccgggacccggtaccgtacggtacgttagtacgacgtcggtacgtacgttcgttaccggtttcgttcggtacggtacgggtacgggtaccgggtacggtaaccggtaacggtcgggtcggggttcgggttcggggtacgggtaacgggtaacggttaccggtacggttcgtacggtacgttacgttacggacctaacgacgcccgtaccggtcccgttacccgtccccgttccgtcc

SEQ ID NO: 376502 - DNA, 578 bp, Homo sapiens
  misc_feature: GZ8MTXP01BY2RP.11.12.B01.1.454.CMB.2.raw
  modified_base (213)..(213): a, c, t, g, unknown or other
  modified_base (236)..(236): a, c, t, g, unknown or other
  modified_base (240)..(240): a, c, t, g, unknown or other
  modified_base (482)..(482): a, c, t, g, unknown or other
  modified_base (488)..(488): a, c, t, g, unknown or other
  modified_base (502)..(502): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtgtcccccgganagacagccaccatcagctgctcngganatgtcttgactaatgagtatgtcttcctggtatcagcagaagcaggccacgccccctgtcctactcacttcttacaaactccgaggccccgtccctcgtcggggtcccctggaacgcgtaacttccgtcccgggctcccgggctcggtacgggaaaccactaggtccactcgtacgaccctaagtccacgggccggggaccccagggtctaagttcgagtcggaggtctcgtctacgttcgngtacgnggtccggtggaacncgaagtcggttggtaggttccggacggaggcccgttgttcgccgtcgtccgttaggccgacgtcccgaaggtcccg

SEQ ID NO: 376503 - DNA, 570 bp, Homo sapiens
  misc_feature: GZ8MTXP01DJLDT.11.12.B01.1.454.CMB.2.raw
  modified_base (197)..(197): a, c, t, g, unknown or other
  modified_base (434)..(434): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtgtccccccgganagacagccaccatcagctgctctggagatgtcttgactaatgagtatgcttcctggtatcagcagaagcaggccacgccccctgtcctactcattctttacaaaactccaggccgccctcgtcgggggccctgacgcgtattccgtccggcctccgggctcgtagggaaacacagtccactctacgacccatcgacggccggaccgaggctattgatgagctgtctacgttctgtcngggcgtagggacaacgaggcgttgggtcggttcgggcgggaacgggtaccttaggtccttacggtaccgttcgttacgggttccacggtccccgaacgggtccctacggcccccgttcggtcccttaacgttcccg

SEQ ID NO: 376504 - DNA, 642 bp, Homo sapiens
  misc_feature: GZ8MTXP01E2M8L.11.12.B01.1.454.CMB.2.raw
  modified_base (198)..(198): a, c, t, g, unknown or other
  modified_base (226)..(226): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtcccgtcgtccccccgganagacagccaccatcagctgctctggagntgtcttgactaatgagtatgcttcctggtatcagcaagaaggcaggcccacgcccccctgtccctactctacttactttaaccaaaactacccgaaggtccggcccttcgtcgggggtcccctggacgtcgtacgttccgtcccggtctcccgggctccgtaggggaaaccacagtcaactctacgaaccagtccgacggaccggacccgaagggtcctagttgagttggacggtctgtccttacttcgtgtcgacgggtcggtacgggacaaacggtacgtccgggttagggtcggttcggggcgggaacggggcccttagggtcttcgggacccgtttcggttaacgggttcgaaccggtcccgaacgggtcccttcccggtcccccgttcgggttaacccttccgtttccccg

SEQ ID NO: 376505 - DNA, 588 bp, Homo sapiens
  misc_feature: GZ8MTXP01AWXHY.11.12.B01.1.454.CMB.2.raw
  modified_base (197)..(197): a, c, t, g, unknown or other
  modified_base (224)..(224): a, c, t, g, unknown or other
  modified_base (396)..(396): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtgtccccccgganagacagccaccatcagctgctctggantgtcttgactaatgagtatgtcttcctggtatcagcaggaaggcacggccacgccccctgtccctactctattccgtttaacaaaactcccgaggccggtcccctcgtcggggtccctgaccgcgtacttcgccgcgtcccggctcgtacgggacacgatcactctcgaccncgacgacggaccggaccgaggtactagtgagtcggcgtcgtcgttcgttacgttcgtcgtcgacggtacggtacggacgacggtacggtcggtgggtcgggtcgggcgggtaacggtcgttacgtcgttacgtacgttcgttacgttcgacgaaccgacgtccgtcccgtcccgttccgtccgttccgtccg

SEQ ID NO: 376506 - DNA, 601 bp, Homo sapiens
  misc_feature: GZ8MTXP01BGKNW.11.12.B01.1.454.CMB.2.raw
  modified_base (199)..(199): a, c, t, g, unknown or other
  modified_base (283)..(283): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtccccccgganacgacagccaccatcagctgctcgtggagatgtcttgactaatgatatcgtcttctggatcagcagagcgaggccacgcccctntccctactctattacttacaaactccgaggtccgcccttgtcggggccctggaccgcgtacttccgccggtctcccggctcgtagggaaccacgacgtcactcgtacgaccactcgacggaccgggacccgtagccttagtgagtggagtccgttagttccttacgttcgtcggttcgagggtcggtacggaacgaacgtacggtcggttcgggtcggttccggggcgggaacgggtacgttacgtcgttcggtaccgttcggttaacgcgacgcccgaacggtccgtcccggccccgttcggtccttaaccgttccc

SEQ ID NO: 376507 - DNA, 661 bp, Homo sapiens
  misc_feature: GZ8MTXP01A9ZGX.11.12.B01.1.454.CMB.2.raw
  modified_base (213)..(213): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgccaccctcatcgtccgtcgtcccccgganagacacgccaccatcagctgctcgtggatatgtcttgactaatgagtatcgtcttccgtggtactcgagacgaaggaacggcctacgggccccaccggtccccctgtacccctactctattactttaacaaaactccgacggcccccgtcccgtcgtcgggggtccctggaacgtccgtcgttccgccccggggtcttccccggggtctacggtacggggaaaccctacgtacgtcctacgtctacgaccacgtcgacggtcccgggaccagtcttagttcgaggttggacgttctacgttacttccgttcgtggtaccgcgggtacgtagggaaccctaaggtcgggtcggttggggtacgttccgggggacgggtaacggacccgttggttacccggtaacggtccggttcgttacgggccgaccggtcccgttaacggtcccccg

SEQ ID NO: 376508 - DNA, 642 bp, Homo sapiens
  misc_feature: GZ8MTXP01AP0DN.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatctctctcttcctcggcgtccttgcttactgcacagaatccatcggcctcctatgagttgactcagccaccctccatcgtccgtcgtcccccgganagacacgccaccatcagctgctcgtggagtagttgtcttagaacttaaatggtagtatcgtcttcgtggtactcgagcagaacggcacggcccacgccccctgtacctactctaacttacctttaacaaaacgtccgacgggtcccgtcccgttcggtccggggtccctggaccgtcgtacgttcccgtcccggtcctcccgggtctcgtacgggaaacctacgtacgtccactcgtacgaccagtaccgacggaccggacctaggtctagtgagttgaggtcttcgtacgtttacgtacgtcgtacgacgggtcgtacggaacgaacggtggtcggttgggtcggttcgggaacgggacggcctacggttcgtacgtacccggttgttacggccgaacgtcccgaacggtcccgacccggttccccgttcggttaaccctcccg

SEQ ID NO: 376509 - DNA, 602 bp, Homo sapiens
  misc_feature: GZ8MTXP01DHQGT.11.12.B01.1.454.CMB.2.raw
  modified_base (195)..(195): a, c, t, g, unknown or other
  modified_base (222)..(222): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtccccgganagacagccacatcagctgctcgtgganatgtcttgaactaagtgagtatgtcttcgtggtatcagcaaggacggcacggccacgccccctgtccctactctattactttacaaaactccgacgggccgtccctcggtcggggtccctggaccgcgtacttccgtccggcctccgggctcggtacgggaaacacgtacgtccactctcgaccacgtacgacggaccgggacccaggtacttagtgagtcgacggtcttgtaccttacgttcgtcggtcgacggcggtacggacgaacggacggtcggtgggtcggtccggggcgggaacgggtcgacggtcgttacgtaccgttcgttacggcacggtcccacggtcctcccggccccgttcgtcccgttcgttcccg

SEQ ID NO: 376510 - DNA, 661 bp, Homo sapiens
  misc_feature: GZ8MTXP01DGDES.11.12.B01.1.454.CMB.2.raw
  modified_base (200)..(200): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtccccccggaanacgacacgccacatcagctgctgtaggatattgtcttagaactaagtgagtatcgtcttcgtaggtactacgagacgaaggaacggccgacggcccacccgtccccctcgtaccctactacctaacttaccttaaacaaacgtacccgacggcccggtccgtcggtcgggtcctggaccgcgtacgtccgtccgccgtccgcgtcggacgaacacgtactccactcacgaccagaccggacggaccggaccgagtactagtagagtcgacgtcgttacgttcttacgttcgtcggtacgacgggtacggtacggaacgacggtacgggtcggttgggtcgggtcgggacggggtaacgggtacgttcggttcgttaccggttaccggttacggttaccggccgacccggaacccggtacggtcccgtccccggtccccgttcggtcccgttcccgttcccg

SEQ ID NO: 376511 - DNA, 680 bp, Homo sapiens
  misc_feature: GZ8MTXP01BR4TP.11.12.B01.1.454.CMB.2.raw
  modified_base (198)..(198): a, c, t, g, unknown or other
  modified_base (227)..(227): a, c, t, g, unknown or other
  modified_base (376)..(376): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacacgccaccatcagctgctcgtgganatgtcttgactaatgagtatgtcttccgtgatcagcaagagcacggccacgccccctgtccctactctacttactttacaaaatcccgacggccgtcctcgtcggggcctgacgcgtactccgtccggctccggcttcgacgggaaccncacgtcacttcacgaccatcgacgggccgggaacccagggtacctttagtagagtacggtacggtcttaggttccctttacgttcgttacggtccgacgggtcggtacgggaaccaacggtcgggttcggttcgggggttccgggtttaccgggggcgggtaaaccggggtaacccttcggggttacccgttcggtaaacccggggttttacctttacgggggcccgaaaccgggtaacccccggtaacggggtcccctcccccgggtcccccgttccgggtaacccttcccgttttcccccgg

SEQ ID NO: 376512 - DNA, 529 bp, Homo sapiens
  misc_feature: GZ8MTXP01A9EBM.11.12.B01.1.454.CMB.2.raw
  modified_base (194)..(194): a, c, t, g, unknown or other
  modified_base (421)..(421): a, c, t, g, unknown or other
  modified_base (442)..(442): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttctggatcagcagaaggcaggccacgccccctgtccctactcatctttacaaatcccaggccgccctcgtcggggtccctgacgcgtatcgtcccggctcccgggctcgtagggaaaccactacgtcactctacgacctatcagcacggacccaggctatgatgagctgtctacttngtcgagggcgtgggacaacgnggtcgtgggtcggtcgggcggagggacctggttccgtcgtaccgttgttcggcaacgcccgtaaggcctcgccccctggttctcccg

SEQ ID NO: 376513 - DNA, 690 bp, Homo sapiens
  misc_feature: GZ8MTXP01CA74G.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgccaccctccatcgtccgtcgtccccgganagacacgccaccatcagctgctcgtggatattgttcttagaacttaatgagttatgtcttccgtaggtatcgagacgaaggaacggccacggcccaccgcccccttgtcccctactctacttactttaacaaaactcccgacgggccgtcccgtcggtcggggtccctggaccgcgtattccgcccggcgtacccggctcggacggaaccacgtacgtcctacgttcacgacctagtaccgaccgggaccggaacccgaggtaccttagtacgagtggacgtcgttacgttacctttcggttcgttacggtccgtacggggtacggtacggaaccgacggtcgggtccggttgggggtacgggttccgggggacggggtaaccgggtaacttcgggtaccgttacgggttaacccggttcggtttacgggccgaccgggtccccggacgggtcccgtccccgtccccgtttcgggtaaccccttcgtttccccg

SEQ ID NO: 376514 - DNA, 593 bp, Homo sapiens
  misc_feature: GZ8MTXP01DTPZA.11.12.B01.1.454.CMB.2.raw
  modified_base (238)..(238): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtccgtcgtcccccggacagacacgccaccatcagctgctntggagatgtcttgactaatgagtatgcttctggtatcagcaagagcaggccacgcccctgtcctactcattactttacaaaactccgacggccccgccgtcgtcggggtccctggaacgctcgttcccgtcccgggtccgttcccggcgttacggtacggggtaaaccactacgtactactcgtacgaacactcgacggaccgggacccaggtctagtgaggtggacggtcttcgtcttactcgtcgcgtacggtcggtaggaaccaaggcggtcggttgggtcgggttcgggacgggtacgggacccttggttactcggtacgttcgttacggcgacgtcccgttaaggtcccg

SEQ ID NO: 376515 - DNA, 667 bp, Homo sapiens
  misc_feature: GZ8MTXP01CTTEN.11.12.B01.1.454.CMB.2.raw
  modified_base (264)..(264): a, c, t, g, unknown or other
  modified_base (617)..(617): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatcgtccgtcgtcccccggaagacacgccacatcagttgctcgtggagtattgtcttagaactaagtgaagtatgtcttccgtaggtancgagacgaaggaaacggtcgacggccctacgcccccttgtccctactctaacttacctttaaacaaaacttcccgagggcccgtacccgttcggtacgggggtcccctggacggtcccgtactttccggtccggtaccgtcccgggacttacggcgggaaaccacgtacgtacaccgtcgtacgaaccctagtaccgacgggaccggggacctagggtacttagttgaacgtggtacggtcttgttaccttacgttcggtcggttacgaacgggttcggaaggaacaacgtggtacggtggtacgggtcggacgggacggctaggttcgtaccgcggttactacgggttaccncggaccgtaacggtcctcccgcccgttaccggctcccgttcgttcccccg

SEQ ID NO: 376516 - DNA, 642 bp, Homo sapiens
  misc_feature: GZ8MTXP01DPKL0.11.12.B01.1.454.CMB.2.raw
  modified_base (215)..(215): a, c, t, g, unknown or other
  modified_base (242)..(242): a, c, t, g, unknown or other
  modified_base (270)..(270): a, c, t, g, unknown or other
  modified_base (538)..(538): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatcgtccgtcgtcccccgganagacagccaccatcagctgctctgganatgtcttgactaatgagtatgtcttccnggtatcagcaaggacgcacggcccacgccccctgtcctactctacttacctttaacaaaactccgacggcccccggtcccttcggtcgggggtcccctaggaacgtccgtaacgtccgtcccgggcctccgggctcggtacgggaaaccacgacgtcacctctacgacctacgtccgacggcccgggaacccgaggtcttagttggacgtcggtacggtcttcggtacttacgttcgtcgtacgacggtcggtacggaaccgaacggnggtccggttggggttcgggttccggggacggggacgggttaccgttggttccgtcgggtaacccgttcgttaacggccgttacggtccccgttaacggtccccg

SEQ ID NO: 376517 - DNA, 591 bp, Homo sapiens
  misc_feature: GZ8MTXP01AFF8X.11.12.B01.1.454.CMB.2.raw
  modified_base (212)..(212): a, c, t, g, unknown or other
  modified_base (238)..(238): a, c, t, g, unknown or other
  modified_base (350)..(350): a, c, t, g, unknown or other
  modified_base (474)..(474): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatcgtccgtgtcccccgganagacagccacatcagctgctctgganatgtcttgactaatgatatgtcttctggtatcagcaggaaggcacggccacgccccctgtccctactctattctttacaaaactccgaggccccgccctcgtcggggtcccnggaacgcgtcttccgcccgggtctaccccggctcgtacgggaaacccacgacgtcactctacgacacgtcgacggccggaccaggctagttgaggtgaggtcttcgtacttacttcgtgtacgnggtcgtacgggacaacggtggtcgggttgggttcggttccggggacgggacggggttacccgttggttccgttcgggtaccgttcgttacggtccgacgccccgttaagggtccccg

SEQ ID NO: 376518 - DNA, 722 bp, Homo sapiens
  misc_feature: GZ8MTXP01EVNZJ.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatcgtccgtcgtcccccgganacgacagcccaccatcacgctgcttcgtggagtattgttcttagaactaagtgagtatcgtcttccgtggatcgagacgaaggaacggcgacggccccacgtcccccctgtccctactctacttacctttaacaaaacgtcccgacggtccggtcccttcggtcggggtcccctggaccgtccgtacgttcccggcccggcccttccgggcgttcggtacgggaaaccactacgtaccaccgtctacgaacctcgtacgaccgggaccggacccgaggttaccgttagttcgaaggttcgacgggttcttacggttacccttacgttcgttcggtaccgggacgggtacgggtaacgggaactaaacgggcggggttccgggttggggtccgggttacggggcggggtaaaccgggtacgttacggtcgttaccgggtaacccgttacgttacgggttcgacccggtaaccccggtacggtccccggtcccgtcccccggttacggttccccttccgtttccccgg

SEQ ID NO: 376519 - DNA, 662 bp, Homo sapiens
  misc_feature: GZ8MTXP01DAV7W.11.12.B01.1.454.CMB.2.raw
  modified_base (197)..(197): a, c, t, g, unknown or other
  modified_base (393)..(393): a, c, t, g, unknown or other
  modified_base (405)..(405): a, c, t, g, unknown or other
  modified_base (424)..(424): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgcccaccctcatcgtccgtcgtcccccgganagacacgccacatcagctgctcgtggatattgtcttagaactaatgtagttatgtccttccgtggtactcaggacaaggaacggcacggcccaccggtccccccttgtacccctactctatttacctttaacaaaacgtccgacggcccgtccctggtccggggtcctgaccgtccgtattccgccgtctcccggnttcgacggaacncgtcgtcactcacgacctntccggacggccggacccgtagtacttagttgaagtcgacggtcttcgttacttacggttcgtacggtacggacgggtcgggtacgaaaccgtaggtacgggttcgggttcggggtcgggtaccgggcgggggtaaccgggtccgttacggttcgttaccggttaccggttcgttaccgggccttacggaaccccgtggcccttccccggccccgttcggtcccttaaccgtttccccg

SEQ ID NO: 376520 - DNA, 706 bp, Homo sapiens
  misc_feature: GZ8MTXP01BEUSW.11.12.B01.1.454.CMB.2.raw
  modified_base (213)..(213): a, c, t, g, unknown or other
  modified_base (305)..(305): a, c, t, g, unknown or other
tcagcgagagataccacgaccggtgctcgatttagtagtgtagattccgcgggggtggaagaacctgcccagcctgggcctcaggaggcagcatcggaggtgcctcagccatggcatggatccctctcttcctcggcgtccttgcttactgcacagaatccatcggcctctatgagttgactcacgccaccctcatcgtccgtcgtccccganagacacgccacatcagctgctcgtggagtattgtcttagaactaagtgagtatcgtcttcgtggtactcgagacgaaggacggcacggcccnccgtccccttgtcctactactacttacttaacaaaacgtccgacggtccccgtccgtcggtcgggtccctggaacgtcgtcgttccgccggtcctccgaccgtcggacgaacacgtacgtctacctcgtacgacctacgtacgaccgggacccgggtaaccgagttaccttaagttacggagggttacggtacggttcttacggtttaccttccgttcgttcggtaaccggtcggggtaccgggtaacgggaaccgtaaacggggtcggttaccggggttcgggggtcgggttcccgggggaaacgggtaccggggttaaccgttcgggttaccggttaacggtacccggtttaacggtaaccgggtaccgacccgggtaacccggaaccgggttccccgg

SEQ ID NO: 376521 - DNA, 715 bp, Homo sapiens
  misc_feature: GZ8MTXP01BQ8RJ.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagccaccctccatcgtccgtcgtcccccgganacgacacgccaccatcagctgctcgtggatattgtcttagaacttaatgagttatcgtcttccgtaggtactcgagacgaaggaacggcacggcccacgtccccctgtaccctactctacttactttaacaaaacgtcccgacggtcccgtcccgttcggtcggggtccctaggaccgtccgtacgttcccgtcccggtcctacccgggtctcggtacgggaaacctacgacgtccaccgtctacgacctacgtaccgacgggaccgggaacccgaggtaccttagttacgagtacggacgtcgttacgttaccgtttacgtttcgttcggtaccggacgggtcggtacggaaccgtaacggtcgggtcgggttggggttacgggttccggggacgggtaacggggtaccgttacggttccggttacggtacccggttacgttaccgggttccgacccggtcccggtaacggtcccgtccccggtcccccggttacggtccccgttaacccgtttccccg

SEQ ID NO: 376522 - DNA, 600 bp, Homo sapiens
  misc_feature: GZ8MTXP01CMMDY.11.12.B01.1.454.CMB.2.raw
  modified_base (194)..(194): a, c, t, g, unknown or other
  modified_base (221)..(221): a, c, t, g, unknown or other
  modified_base (484)..(484): a, c, t, g, unknown or other
  modified_base (568)..(568): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtcttgactaatgagttatgcttctggatcagcaaggaggcacggccacgccccctgtccctactcattcttacaaaatcccgaggccgcctcgtcggggtccctggaccgtcgacttccgtcccggctcccgggctcgtacgggaacacgtacgtccacgtcctacgaccacgtcgacggccgggaccagggtcttaagttgagtggacggtcttcgtcttacgttcgtcggttcgacgggtcggtacggggacaaacgngggtcggtggggtcgttcggggcgggtaacggtacgaggttccgcggtaccgttcgttacggttccacgggcccaacgggtccncggtcccccgttcgggtaaccttccgtttccc

SEQ ID NO: 376523 - DNA, 752 bp, Homo sapiens
  misc_feature: GZ8MTXP01DM4DF.11.12.B01.1.454.CMB.2.raw
  modified_base (198)..(198): a, c, t, g, unknown or other
  modified_base (226)..(226): a, c, t, g, unknown or other
  modified_base (245)..(245): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacacgccacatcagctgctctggagntgtctgaactaatgagttntgtcttcgtgtatcagcaagaggcacgccaccgcccctgtccctactctaacttctttaacaaacgtacccgacggcccggtccttcggtacgggtccctggacccgtaccgtactttcccggtcccggtccgtcccgggcttaaccgggtagggaaaccctaacgggtactccgacctcgtacggaccctacgtcgaccgggaccgggaccccgaggtacgttagttaggagtgggaacggtcttacggttccttaacgggtttccgttagggtaccggtaacggggttaccggtaagggaaccctaaagggtacgggttccgggttgggggtttcggtaccgggggcgggttaaacccggggtaccgttaacggttccggttacccggttaaaccgggttcggttaaaccggggttccccgaaccggggtcccccggtaaacggtcccccggttaaccccgtccccccggttaacgggttcccccttcccgggtttttcccccgg

SEQ ID NO: 376524 - DNA, 681 bp, Homo sapiens
  misc_feature: GZ8MTXP01DZNUF.11.12.B01.1.454.CMB.2.raw
  modified_base (197)..(197): a, c, t, g, unknown or other
  modified_base (263)..(263): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatcgtcccgtcgtcccccgganagacacgccacatcagctgctctggagattgtcttagacttaatgagttatcgtcttccgtggtancgagcgaaggaacggcacggcccaccggccccctgtaccctactctacttacttaacaaaactcccgaggcccgtccgtcgtcggggtcccctggaccgtccgtacttcccgtcccggtcccgtcccggcttccggacgggaaccacgtacgtcaccgttcgtacgaccctacgtacggacgggaccgggacccagggtacttagtggtacgtacggacggttcttcgttaccttaccggttcgtcggtcgaacggggtccgtaggggaaacctacggtacgggtggttcggggttcgggtcccgggggaggtaacgggaccgttaggttccgttagggtacccgttcgttacggccgttaccggaaccccggtagtccccgtcccggtccccgttcggtccgttaaccgtttccccg

SEQ ID NO: 376525 - DNA, 627 bp, Homo sapiens
  misc_feature: GZ8MTXP01DF26H.11.12.B01.1.454.CMB.2.raw
  modified_base (223)..(223): a, c, t, g, unknown or other
  modified_base (535)..(535): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcacgcccaccctcatcgtccgtcgtcccccggaagacacgccacatcagctgctcgtgganatgtcttagaactatgagtatcgtcttccgtggtactcagacgagaacggcacggccaccgcccctgtcctactctattacttacaaaacgttccgacggccgtccttacggtcgggtccctgacgccgtattccgccggcctccggctcggtacgggaaaccacgtacgtcctactcgtacgaacctacgtccgacgggaccgggaaccctagggtaccttaagttcgaacgtggacgtccttgttaccttcgttcgtgttaccgagggtcgtagggaaccaaggtacggtcgttaggggtcggtccgggngggaacggtacgagtccgttcgtaccggtcgttacggcaccggtaaccgtacggtccgtacccgtccccgttacgtcccttcgttaaccccg

SEQ ID NO: 376526 - DNA, 598 bp, Homo sapiens
  misc_feature: GZ8MTXP01C6PHX.11.12.B01.1.454.CMB.2.raw
  modified_base (212)..(212): a, c, t, g, unknown or other
  modified_base (504)..(504): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcagcccaccctcatcgtccgtcgtccccgganagacacgccacatcagctgctctggatatgtcttgactatgagtatgtcttcgtggtactcgagcgaaggacggccacggcccaccgtccccctgtaccctactcactttaccttaacaaaacgtccgacggtccccggtaccctcggtcggggtccctggaacgtccgtcgttcccggtccggccgttccccggcgtacggtacggggaacctacgtacgtacctacgtctacgaccagtccgacggccggacgagtctagtcgagtcggcgtctcgtctcgtcgtgacgnggtcgtacggacaaggcggtcggttgggtcggttcgggaggtacggttacgttacggcgtcgaccgtcgtacgccgacggtccgaacgtccccg

SEQ ID NO: 376527 - DNA, 573 bp, Homo sapiens
  misc_feature: GZ8MTXP01EJOAX.11.12.B01.1.454.CMB.2.raw
  modified_base (212)..(212): a, c, t, g, unknown or other
  modified_base (239)..(239): a, c, t, g, unknown or other
  modified_base (476)..(476): a, c, t, g, unknown or other
  modified_base (492)..(492): a, c, t, g, unknown or other
  modified_base (527)..(527): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcagccaccctccatgtccgtcgtcccccgganagacagccaccatcagctgctctgganatgtcttgactaatgagtatgcttctggtatcagcagaaggcaggccacgcccctgtcctactcatctttacaaaatccgacggcccggcccctgtcgggggtcccctggaaacgtccgtaacgtttcccgcccgggtcttccccgggcgttacgtacggggaaaccacgagtccactctacgacccatccgagccgggacccaggctagttgatgaggtctgtcttactgtgtacnggtcgtaggacaacgnggcggttgggtcggttcgggcgggtacgggaccgngttcgtcggtaccgttcgttacgggtcacgtcccgaagggtccccg

SEQ ID NO: 376528 - DNA, 728 bp, Homo sapiens
  misc_feature: GZ8MTXP01EJ79T.11.12.B01.1.454.CMB.2.raw
  modified_base (195)..(195): a, c, t, g, unknown or other
  modified_base (224)..(224): a, c, t, g, unknown or other
  modified_base (250)..(250): a, c, t, g, unknown or other
  modified_base (266)..(266): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccacctcatcgtcccgtcgtcccccgganacgacacgccacatcagctgctgtggatnttcgtacttagaactaagtgtagttntcgtcttcgtagtacncgagacgaaggacggccgaccggcccacccgtcccccttgtaccctactactacttaccttaaacgaaacgtcccggacggtcccgtccgttcgggtcgggtcctaggacccgtccgttacgttcccggtcccggtcccgtacccgggtacgtcgggtaacgggaaaccctacgtacgtacctacgtcgtaacgacctacgtaccggaccgggtaccggaaccgtaggttacttagtgacgtggtacgtcttacgttaccttcggttcggtacggtacggacgggtacggtacggaacgtacgggtcgggtcgggttagggtccgggtaccggggacgggtaacggtaccgttacgggttaccgttacgggttacccggttacggttaccggttcccgaccggtaacccggtacggtccccgttccccggtccccggttcgttaaccccgttcccgttcccg

SEQ ID NO: 376529 - DNA, 649 bp, Homo sapiens
  misc_feature: GZ8MTXP01AOUB4.11.12.B01.1.454.CMB.2.raw
  modified_base (216)..(216): a, c, t, g, unknown or other
  modified_base (238)..(238): a, c, t, g, unknown or other
  modified_base (243)..(243): a, c, t, g, unknown or other
  modified_base (271)..(271): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatcgtcccgtcgtcccccgganagacacgccacatcagctgctntggantgtctgactatgatatcgcttcgtgtancagcagaacggcacggcccacggccccctgtcctacctctacttacttacaaaacgtccacggccccgccgtcggtcgggtccctgaacgccgtctccgcccggtcttcccgggcgtcgtacgggaaaccaccgacgttacaaccgtcgtacgaacccgtacgacgaaccgggcccgggaaccctagggtacttacgttagagggtcggtacgggtccttcggttaccttaccgttgttacggtacgtaccgggtcgggtacggaaaccacggaacgggtcgggttcgggtcgggttccggggacgggacgggttaacccgttggttccggtaacggtccgttaacgttaggccgttaccgcccggttaacgtccccg

SEQ ID NO: 376530 - DNA, 657 bp, Homo sapiens
  misc_feature: GZ8MTXP01B308M.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtccccccgganagacacgccaccatcagctgctctggagatgtcttgactaatgagtatgcttcctggtatcgagcaaggaaggcaggccacgtccccctgtccctactcacttctttaacaaaactcccgaggccggtcccctcggtcgggggtcccctggaccgtcggtacttccgtcccggtccgtcccggctcgtacggggaaccacgtacgtccacgtctcgaccacgtccgacgggacccgggaccgacggtacctagttgaacgttggacgtcgtcgttaccgtttacgtttcggttggtaccggaacgggtcgggtacgggaacgtaacggtacggtccgggttgggtcgggttccggggcggggaacggggtccgttaggtccgttcgggtaccgttcgttacggttccgacgcccgtaacggtccgtcccggtccccgttcgggtcccttaaccgtttcccg

SEQ ID NO: 376531 - DNA, 681 bp, Homo sapiens
  misc_feature: GZ8MTXP01AV9OE.11.12.B01.1.454.CMB.2.raw
  modified_base (196)..(196): a, c, t, g, unknown or other
  modified_base (226)..(226): a, c, t, g, unknown or other
  modified_base (340)..(340): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganacgacacgccaccatcagctgctcgtgganatgtcttagactaatggagtatcgcttcctggtatcagcgagaacggcacggccacgtccccctgtccctactctattacttacaaactccgacggccgtcctcgtcgggtccngaccgcgtacttccgccggtcgtcccggcgtcgtacgggaaaccacgtacgtacctacgtctacgaccacgtcgacggccggaccgagtactagtcgagtgagtcttcgttaccttacggttcgtcggtccgacggggtcggtcggaaccaacgggtcggtcgggttacggggttcgggttaaccgggggcggggtaaaccggggtcccgttagggttccggttaccgggtaacccgggtttacgttaacgggggttcccaaccgggtaaccccgggtaaccgggtccccgttccccggggccccccgttcgggttaaccccttaacccgttttcccccgg

SEQ ID NO: 376532 - DNA, 821 bp, Homo sapiens
  misc_feature: GZ8MTXP01CAU27.11.12.B01.1.454.CMB.2.raw
  modified_base (215)..(215): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgcccaccctccatcgtccgtcgtccccgganagacacgccaccatcagctgctcgtggatatgttcttagactaatgatatcgtcttccgtggtatcgagcaaggacggcacggcccaccgtccccctgtcctacttctacttactttaacaaaactccgacgggtcccccggtaccccgttcggtcggggtacccctaggtaaccggtccgtcgttcccggtcccgggtcccgttccccgggtccttacgggtaacggggaaacctaccgtacgttaccctacgtaccgttacgaaccccgtaacggttccgaaccggggtacccggggaacccctagggtaacccgtttaagttaccgggtaaggggttcgggttaacgggttccgtttaccggtttacctttaccgtttaccgggtcggtttacccgggaaaggggtccgggttaacggggaaccccgttaaagggcgggggttccgggggtttagggggtttacccggggtttcccggggggaaaccggggtaacccgggggttaaccgttacgggttcccgggtttaaccgggtaacccgggtttcggttttaccggggccgttaacccgggtttaacccggaacccggggtttccccccgg

SEQ ID NO: 376533 - DNA, 643 bp, Homo sapiens
  misc_feature: GZ8MTXP01DWO6Y.11.12.B01.1.454.CMB.2.raw
  modified_base (196)..(196): a, c, t, g, unknown or other
  modified_base (222)..(222): a, c, t, g, unknown or other
  modified_base (249)..(249): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccacatcagctgctctgganatgtcttgactaatgagtatgtcttcnggtatcagcaagaaggcacggccacgccccctgtccctactctattactttacaaaactcccgacggccggtccctcgtcgggggtccctggacgcgtattccgtcccgggcctcccgggctccggtacgggaaaccacgtacgtaccacgttctacgaacctactacgacggccgggaacccgacggtacttagttgagtgacgtctcgttcttacttcgtggtcgacggcggtggaaccgaacgacggtcggttaggggttcggttacggggcgggaaacgggtacgttaaacggtccgttacggtaacccggttaccgttaacggttccgaccggtaaccccgaaggtcccgtacccggtcccccgttcgtaaccccgttaacttccccgg

SEQ ID NO: 376534 - DNA, 700 bp, Homo sapiens
  misc_feature: GZ8MTXP01BA378.11.12.B01.1.454.CMB.2.raw
  modified_base (217)..(217): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgcccaccctccatcgtcccgtcgtcccccgganacgacacgcccaccatcagctgctcgtaggagtattgtcttagactaatgagttatcgtcttccgtggtactcgagcgagacggcaggcccacgccccctgtcctactctattacttacaaactcgacggccccgtccgtcgtcggggtccctggacgtctcgttccgcccgggtacctcccgggtacttcggtacgggaacctacgacgtacacctcgtacgacccgacgtaccggacggaccgggacccagggtaccttagttcggaaggggttcggtaacgggttcctttacgggtttacctttaccgtttcggttcggttaccggaacggggttccgggtaaacggggaacctaacgggtaacgggttggggttcgggggttcggggttccgggggacggggtacggggaacccgttggttcccggtaaccggttccggttaacggttacgggccgaccggtcccgaacggttcccccg

SEQ ID NO: 376535 - DNA, 544 bp, Homo sapiens
  misc_feature: GZ8MTXP01DT2ZP.11.12.B01.1.454.CMB.2.raw
  modified_base (196)..(196): a, c, t, g, unknown or other
  modified_base (250)..(250): a, c, t, g, unknown or other
  modified_base (536)..(536): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtgtcccccgganagacagccaccatcagctgctctggagatgtcttgaactaatgagtatgcttcnggtatcagcaagaaggcacggccacgccccctgtccctactcctaattctttacaaaatcccgaggccgtcctcgtcggggtcctgacgcgtattccgtccggctcccggctcgtgggaacacagtccactctacgaccatcgacgccggaccaggtactagttgagtgagtctgtctacgttctgtcgaggcgtggacagacgtcggtggtggttcggcggaaggcgaggtcgttcgtaccgtcgttacggttcacgccgaagcctccgccccgttcggtaaccncgttcccg

SEQ ID NO: 376536 - DNA, 785 bp, Homo sapiens
  misc_feature: GZ8MTXP01EA69M.11.12.B01.1.454.CMB.2.raw
  modified_base (214)..(214): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgcccaccctcatcgtccgtcgtcccccgganagacacgccacatcagctgctcgtaggatatgtcttagaactaatgagtatcgtcttcgtggtactcgagcgaggacggcacggcccaccggtcccccttgtccctacttctacttcctttaacaaactccgacggtccccggtccccgttcggtcggggtccctggaacgtccgttcgttcccgtcccgggtcccgtcccgggtccgttccgggtaacgggaaacctaccgtacggttaccctaccgtaccgttaaccgacccgtaaccgttaccggaccgggaccccggggtaacccgtacggtaccttaagtttacggtacggggtacggtacggttccgttacgtttaccgttaccgtttccgttaggttaccggtacgggttaccggggttaacgggaaccgtaaacgggtaacgggttaacggggtttcgggggttaccggggttaccgggggaaccgggggtaaccggggttaaccggttccggttacccggtccggggttaccccggttaacggtttacgggaccggttacccggtaaccccggttaaccgggttccccccgg

SEQ ID NO: 376537 - DNA, 776 bp, Homo sapiens
  misc_feature: GZ8MTXP01CZ80P.11.12.B01.1.454.CMB.2.raw
  modified_base (199)..(199): a, c, t, g, unknown or other
  modified_base (233)..(233): a, c, t, g, unknown or other
  modified_base (259)..(259): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtccccccgganacgaccacgcccacatcagtctgctcgtaggatnttgttcttagaacttaagtgtagttntcgtcttcgtaggtactcgagacgaaggacggccacggcccacccgtcccctgtccctactctacttaccttaacaaacgtcccgcggtccgtcccgttcggtcgggtcctaggacccgtccgtacgttcccggcccggtcccgtacccggtacttccggtaaccgggaaacctacgtacgtacctaccgttacgtaccgaaccgtacgtaccggaaccgggacccgggtaaccgtacggtacgttagttacggtacggtcggtacggttcgttaccgtttaccgtttaccggtttcggtacggtaccggtacggggtaccggtacgggaaccgtacggtacgggtcggggttcggggttaccggggtccggggaccggggtaaccgggtaccggttacggttaccggttaccggttaacccgggttccggttaccgggcccggacccggtaaccccggtaaccggtccccgttccccggtcccccggttaccggttccccgttaacccgtttcccg

SEQ ID NO: 376538 - DNA, 661 bp, Homo sapiens
  misc_feature: GZ8MTXP01EP4B6.11.12.B01.1.454.CMB.2.raw
  modified_base (197)..(197): a, c, t, g, unknown or other
  modified_base (409)..(409): a, c, t, g, unknown or other
  modified_base (478)..(478): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgccaccatcagctgctcgtggatatgtcttagactaatgagtatcgtcttcgtggtactcgagcaaggaacggccacggcccacgtccccctgtaccctactctacttacttaacaaaactcccgaggtcccgcccgttcggtcggggtcccctaggacccgcgtacgttccgtcccggccgtcccgggctcggtacgggaaaccncgacgacctactctacgacctagtaccggacgggaccggacccagggtacctagttcgacgtggacgtnttacgttccttacggtttctggttccgagggtcggtacggaaccgtacgacgggtcggttggtacgggtcgggacggggtaacggtcgcgttccggttaggtacccggtttcgttacggttccgaccggtccccgacgggtccctccccggtcccccggttacgtcccgttcccgttccccgg

SEQ ID NO: 376539 - DNA, 649 bp, Homo sapiens
  misc_feature: GZ8MTXP01EUAPK.11.12.B01.1.454.CMB.2.raw
  modified_base (212)..(212): a, c, t, g, unknown or other
  modified_base (501)..(501): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgccaccctcatcgtccgtcgtccccgganagacagccacatcagctgctctggatatgtcttagactaatgatatgtcttctggtatcagcaaggagcacggcccacgtccccctgtccctactctactttacttaacaaaacgtcccgacggtcccccgtacccgttcggtcggggtccctggaacgtccgtaacgttccgcccgggccgtcccgggtctacggtacgggaaccacgcgtcacgtctacgacctacgtcgacgggcccggaccaggtacttagtacgagtcggtacggtctacggttcttaccgttntacggtcggacggtcggtacggacaacggtgggtccgggtttgggggtacggttccgggggaggggaacggttaccggttacgttccggtaacgggtaacccggtttgttacgggacccgttacggaacccggttaacggttccccgg

SEQ ID NO: 376540 - DNA, 619 bp, Homo sapiens
  misc_feature: GZ8MTXP01CQIGX.11.12.B01.1.454.CMB.2.raw
  modified_base (216)..(216): a, c, t, g, unknown or other
  modified_base (245)..(245): a, c, t, g, unknown or other
  modified_base (454)..(454): a, c, t, g, unknown or other
  modified_base (496)..(496): a, c, t, g, unknown or other
  modified_base (505)..(505): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgcccaccctccatcgtccgtcgtcccccgganagacagcccaccatcagctgctcgtgganatgtcttgactatgagtatgtcttctggtatcgagcagacggcacggcccaccgcccctgtccctactctacttacttacaaaactccgacggtcccccggtccctcggtcggggtaccctggaacgcgtcgttccgtcccgggtcgtccgggctcgacgggaaccactcgtccactcgtacgacccagtccgacgggccgggaacccnggtacttagttgacggtgacgggtcttcgttccgtcttcggnggttaccgngggtcgtacgggaaccaggtcggtcgggttgggtcggttacgggcgggtaggttacccgttggttccgttcgtaccggttcgttacggtaccgacggtcccgttaacggtcccg

SEQ ID NO: 376541 - DNA, 710 bp, Homo sapiens
  misc_feature: GZ8MTXP01CDXG0.11.12.B01.1.454.CMB.2.raw
  modified_base (434)..(434): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagccacctcatgtccgtcgtcccccggaagacagccacatcagctgctctggatatgtcttagactaatgtagtactggtcttcctggtaactcgagtacgaaggaacggccaacggccccaacggtccccccttggtacccctacgtacctagttaccttttacaaaacgtcccgaaggggtcccgtacccttcgtacgggggttcccctagggaccgtccggtacttcccgccggtccgttaacccgggcttcggacggggtaaacccncgtacgtacctacgtacgtacgacctacgtaccggacgggaccgggtaccgaggttaccgtacgtaggtacgtacggtacgttcgttacgttacccgttacggttcgtacgggtaccgtacgggtacggtacggaacgtaacggtacggtcggttacgggttccgggttaccggggacggtaacgggtacgttacggttcgttacggtaccggttcgttacggcgaccggtaaccgtacgtccgtacccggtcccgttacgtccgttccgttcccg

SEQ ID NO: 376542 - DNA, 712 bp, Homo sapiens
  misc_feature: GZ8MTXP01DQ3R3.11.12.B01.1.454.CMB.2.raw
  modified_base (196)..(196): a, c, t, g, unknown or other
  modified_base (219)..(219): a, c, t, g, unknown or other
  modified_base (242)..(242): a, c, t, g, unknown or other
  modified_base (458)..(458): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtccccgganagacacgccacatcagctgctgnggatatgttctgaactatgagtntcgtcttcgtgtatcgagacgaaggaacggcgaccgggacctaccgtccccctgttaccctactccgtaactttacttaacaaaacgtcccgacggtcccggtcccgttcgggtccgggtcctagtaccgtccgtacgtttcccgtcccgggtccgttcccggcgttcgggacgggtaaaccctaccgggtaactacctacgtacgacgtaacccnggtaccggaccgggtaccgggaccgtacggttacgttaggttacgaggtcggtacgtcgtttactccgtttacgttcggtacggtcggtacgggtaacggtaccggaacgtaacggtcgggttcgggtcgggtttaccggggcgggacgggtaaccgtcggttcgttaccggttacgttacgtacggttaccggccgttaccgcccgggtacgtcccgtcccggtacccgttcgtaacccgttccgtttccccg

SEQ ID NO: 376543 - DNA, 736 bp, Homo sapiens
  misc_feature: GZ8MTXP01BYCVR.11.12.B01.1.454.CMB.2.raw
  modified_base (248)..(248): a, c, t, g, unknown or other
  modified_base (261)..(261): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatcgtccgtcgtcccccggaacgacacgccaccatcagtctgctcgtggatattgtcttgaactaatgagttntcgtcttcgtgancagacaaggacgcacggccaccgtcccctgtacccctatctacttaccttaacaaacgtcccgacgggtccggtcccgttcggtcgggtccctaggacccgtcgtacgtttcccggtcccggccgttaccccgggcttccggtacgggaaacccaccgtacgtaccctacgtcgtaaccgacccgtagtaccggaaccgggcccgggtaaccctagggtaccttaggtacgaggtacggtcggttagttccgtttacccgttacggggtttcgtcggggttacgtacggggtcggtaacgggaaccgtaacgggcggggttccgggtttaggggttcccggggtaccgggaacgggggtccggtaaccgttacggttcgttacccgggttacgtccgttaacgggttcgaacccggtcccggtacggtcccctccccggggtacccctttacgggtcccctttccggtttccccg

SEQ ID NO: 376544 - DNA, 605 bp, Homo sapiens
  misc_feature: GZ8MTXP01AI7PA.11.12.B01.1.454.CMB.2.raw
  modified_base (213)..(213): a, c, t, g, unknown or other
  modified_base (282)..(282): a, c, t, g, unknown or other
  modified_base (501)..(501): a, c, t, g, unknown or other
  modified_base (519)..(519): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggactccctctcttcctcggcgtccttgcttactgcacagaatccatcggcctctatgagttgactcacgcccacctcatcgtccgtcgccccgganagacacgccaccatcagtctgctcgtggactatcgtcttaggactaagtgagtatcgtctcgtggtacncgagacgaggaacggcgacggccctaccggtccccctgtacctactcgtactttaccttaaccaaacgtccgacggccccgtcccgtggtaccgggtccctagcgtacgtcttccgcccggcgtccgcgtacgacggacctactgtacctacgtcgaccgacacgtcggacgggtccgggacctagtcttagcggagtcggcgtctacgttcttgtcgnggtcgaggtcgagaaccnggtcggtgttagggcggcgggtaacggcgttacgttccggttactccggtacgttcgttcggacgttaccgtaacgccggtccccg

SEQ ID NO: 376545 - DNA, 656 bp, Homo sapiens
  misc_feature: GZ8MTXP01DUVCL.11.12.B01.1.454.CMB.2.raw
  modified_base (218)..(218): a, c, t, g, unknown or other
  modified_base (223)..(223): a, c, t, g, unknown or other
  modified_base (241)..(241): a, c, t, g, unknown or other
  modified_base (250)..(250): a, c, t, g, unknown or other
  modified_base (369)..(369): a, c, t, g, unknown or other
  modified_base (398)..(398): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccacctccatcgtccgtcgtcccccggaagacacgccacatccagctgctgnggatntgtctagactagtgagtngtctctgancagcaaggacgcacggccaccgtcccctgtcctactcatttacctaacgaaactccggacggtcccgtaccgttcggttacggggcctaggcgtaccgtcttccggccgtccgtcccgntcggtacggaactacgtacgtccaccttntacgacctagtacggacgccggacctaggtactgtatagtacggacgtcttcgtactttccgtgtcggtcgacgggcgtacggacgtaacggtcgggtacggttcgggttccgggggcgggtaccgggggtaacggtcggttcggttaacggttccgggttaaccccggttggtttaaccggcccggaaccggtaaccccggtaccggtcccggttaccccggtcccccggttgttcccgttaacccgttttcccccg

SEQ ID NO: 376546 - DNA, 710 bp, Homo sapiens
  misc_feature: GZ8MTXP01BXPQA.11.12.B01.1.454.CMB.2.raw
  modified_base (212)..(212): a, c, t, g, unknown or other
  modified_base (264)..(264): a, c, t, g, unknown or other
  modified_base (701)..(701): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgccaccctcatcgtccgtcgtccccgganacgacacgccaccatcagctgctctggatagtgttcttagactaatgagttntcgtctcgtaggtactcgagacgaggacgcgacgcccaccgtccccctgttcctactcttacttacgtttaacaaacgtcccgaggtcccccgtcccgtacggtccggggtcctggaacgtcgtccttccgtcccggtccgtacccgtcgtccgggtacggaacctacgtacgttaccctaacgtccgtaccgaacccgttacgtaccggacggggtaccccgggaacccgttaagggtcctttaaaggttcggtaggttcggtaacggggtttccttacgtttaccgttaccgtttcgttacgggtaccgtacggggttccggtaacgggaaccaacggtgggggttacccgtttgggggttcccgggttaccggggacggggtacggggaccttacggttcggcgttaccgttcggtaacgccgacgtaacccgnggttccccg

SEQ ID NO: 376547 - DNA, 632 bp, Homo sapiens
  misc_feature: GZ8MTXP01D6WA2.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatcgtccgtcgtcccccggaagacacgccacatcagctgctctggatatgtcttgaacttaatgagtatgtcttccgtggtatcgagcaagacggcacggccacgccccctgtccctactctacttcttacaaaactccgaggccgcctcgtcggggtccctggacgcgtatccgtccggctccggctcgaggaaccacgcgtccacgtctacgacctagtccgacggccgggaccagggtacttagtgagtcgagtctagttcttacgttcgtggtacgagggtcgtacgggacacggtaggtcggttgggtacgggttcggggcgggtaacgggtccgttagggttccgttcgggtaacccggttacgttacggggttccaacccgggtccccgtaaacgggtcccgttcccgggtaccccccggttcgggttaaccccttccggttttccccgg

SEQ ID NO: 376548 - DNA, 501 bp, Homo sapiens
  misc_feature: GZ8MTXP01CF7DW.11.12.B01.1.454.CMB.2.raw
  modified_base (209)..(209): a, c, t, g, unknown or other
  modified_base (230)..(230): a, c, t, g, unknown or other
  modified_base (235)..(235): a, c, t, g, unknown or other
  modified_base (260)..(260): a, c, t, g, unknown or other
  modified_base (295)..(295): a, c, t, g, unknown or other
  modified_base (332)..(332): a, c, t, g, unknown or other
  modified_base (344)..(344): a, c, t, g, unknown or other
  modified_base (363)..(363): a, c, t, g, unknown or other
  modified_base (380)..(380): a, c, t, g, unknown or other
  modified_base (382)..(382): a, c, t, g, unknown or other
  modified_base (403)..(403): a, c, t, g, unknown or other
  modified_base (409)..(409): a, c, t, g, unknown or other
  modified_base (424)..(424): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcagccaccctcatgtccgtgtcccccganagacagccacatcagctgctntgganatgtctgactaatgagtatgctccnggtatcagcagaagcaggccagcccctgtccactnatcttacaaatcagccgccctgtgggccctgaagctntcgcgctcggcnctgggacacagtcactcanaccaatcgagcggaccngntatgatgagctagctacttgngtacgngtcgtagacgaacgngtcgttggtggttcgggtcgggacgggacgttcgttacgtaacgtacggtcgttacggtcgacgtaaccgaacgtcg

SEQ ID NO: 376549 - DNA, 808 bp, Homo sapiens
  misc_feature: GZ8MTXP01ER39C.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacacgccaccatcagctgctcgtggagatgtcttgaacttaatgagtatgcttcctggtatcagcgaagaaggcacggcccacggccccctgtacccctattacacttactttaacaaaaacgttcccgacgggtcccggtccccttacggtcggggggtaccccctaggtaccggtcccgttacgtttcccgtccccggggtcccgtaaccccgggtcttccggtacgggaaaccaccgtacgtcctaccgtcgtcaacccgtagtaccgaccgggccggggaccccgagggttaccttaagtttaggacggtacggacggtccttacggttacccttacggttttcgtcggtaccggtacgggtaccggtaacgggtaaccgtaaaccggtcgggttcccggggttggggttacccggggttacccgggggttaccgggggaaacggggtaccccggttaaacgggttccggttaaccccggggttaaccgtttaccgggttttacgggccccgttaaaaccgggggttcccccgaaacgggttcccccgttacccgggtaccccccccgggtttaccgggtaaccctttaaccccgttttcccccgg

SEQ ID NO: 376550 - DNA, 730 bp, Homo sapiens
  misc_feature: GZ8MTXP01A74UM.11.12.B01.1.454.CMB.2.raw
  modified_base (216)..(216): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatcggcctctatgtagttcgactcacgcccaccctcatcgtccgtcgtccccgganacgacacgccacatcagctgctcgtggatattgtcttagacttaaagtgtacgtagtcgtaccttccgtgtactcgagacgaggaacggccgacggccccgacctacccccgtgtaccccttactacttacttaacctttaacaaaaccgtcccgacgggtccccccggtccttccggtcggggtacccaggtaacgttcgtccgttccgccccgggtactcccgggtaccgtacgggtagggaaaccctacgtactaccgtacctccgtaaccgtacctacgtaccgaccggggacccggaacccgtagggtaccttaaggtacgtacggggttacggtacggttccttacgttaccgttacgttccgtacggtaccggtagggtaccgggtacggaaccgacggtaacggtcgggttagggtccggggttaccgggccgggtaacggccgttcggttaccgtcggttaccgttcggtacggtcccgacggtaacccgttaaccggtccccgg

SEQ ID NO: 376551 - DNA, 734 bp, Homo sapiens
  misc_feature: GZ8MTXP01ARNNC.11.12.B01.1.454.CMB.2.raw
  modified_base (211)..(211): a, c, t, g, unknown or other
  modified_base (226)..(226): a, c, t, g, unknown or other
  modified_base (262)..(262): a, c, t, g, unknown or other
  modified_base (298)..(298): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctcatcgtccgtcgtcccccggaaacgacacgccacatcngtctgctcgaggatnttgtactagactagtgtagttatcgtcttcgtgacncgagacgaaggacgcgaccggcctacccgtcccctntaccctactctacttaccttaaacaaacgtccggacggtccgtcccgtcggtccggtcctaggtaccgtccgtacgttcccgtcccggccgtccgggactcggtacggaacctacgtacgtacccactcgtaccgaccctacgtaccggaccgggacccggtaccgtaggtactagtcgtaggtcggtacgttcttacgttacgtttaccggttcgtacggtaccgggtacgggtaccggtacggtaacgtaacgggtacggggttcgggtacgggggttcgggtaccgggggacggggttaacgggtaccgttacgggttccgttaccggttaaccgggttaccgttacgggttccgttacccggggtaaccccgtaccgggtccccgttcccccgggtccccggttaaccggttccccgttcccggtttccccg

SEQ ID NO: 376552 - DNA, 726 bp, Homo sapiens
  misc_feature: GZ8MTXP01CYG5V.11.12.B01.1.454.CMB.2.raw
  modified_base (199)..(199): a, c, t, g, unknown or other
  modified_base (661)..(661): a, c, t, g, unknown or other
tcagcgagagataccacgaccggtgctcgatttagtagtgtagattccgcggggctgggcctcaggaggcagcatcggaggtgcctcagccatggcatggactccctctcttcctcggcgtccttgcttactgcacagaatccatggcctctatgagttgactcacgcccaccctccatcgtcccgtcgtcccccgganacgacacgccacatcagctgctcgtggatatgttcttagaacttaatgtagtacttcgtcctttcgtaggtactacgagacgaaagggaacggccgaccggtaccccaccccggtcccccttagtaccccttactaccttaactttacctttaaaccgaaactacccggtaccggggtcccggttcccgttacgggttccgggggttccctacggaccgtccggttacgtttcccgtacccgggtcccgtaaccccgggttctaaccggtaacgggaaaccctacggtaccgtaccctacgttacgaccgaacctacgtacccggacgggaccgggacccgtaggtacgttacgtgacgtcggtacggtcttacggttccttacggttcgttcggtcggtaacgggttcggaacggactaacggtggtcgggttgggtcggtccgggacgggaacggtacgngtacgttcgttacgtcgttacggttcacggtccgacgctcccggtcccgcgttccttcgttcccg

SEQ ID NO: 376553 - DNA, 586 bp, Homo sapiens
  misc_feature: GZ8MTXP01B5PIO.11.12.B01.1.454.CMB.2.raw
  modified_base (192)..(192): a, c, t, g, unknown or other
  modified_base (219)..(219): a, c, t, g, unknown or other
  modified_base (360)..(360): a, c, t, g, unknown or other
  modified_base (403)..(403): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccacctcatgtccgtgtcccccgganacgacagccacatcagctgctctgganatgtcttgactatgatatgcttctgatcagcagaggcaggccagccccctgtccctatcgactctttacaaacgtcccgaggtccggtcccttcgtcgggggtaccctggaccgtcgtattcccgtccggacttcccgggntcgtcgggaacacagtcactctcgaccatcgaggcgggtaccnggtactagttgatgacgtctagtcctagttctgtcgaggtcgcggaacacgagccggttggtacggttcgggcgggaacggtaaccgcggttcttcggtaacccggttcgttaacggggttcaaccggtccccgaaggtcccgttccggacccccccgttgggttaacccgttcctttccccg

SEQ ID NO: 376554 - DNA, 602 bp, Homo sapiens
  misc_feature: GZ8MTXP01DFT9T.11.12.B01.1.454.CMB.2.raw
  modified_base (197)..(197): a, c, t, g, unknown or other
  modified_base (346)..(346): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgccacatcagctgctcgtggatatgtcttagaactaatgagtatcgtcttcgtgatcgagacgaaggagcacggaccaccgccccctgtcctactactacttacttaacaaaacgtccgacggccggtcctcggtcgggtccngaccgctacgttccgtccggcgtccggtctcggtacggaaacctacgtacgtctacttcgaccgacctagtaccgacgggaccggaccgtaggtactagtagagtgacgtcttacgtcttacgttcgtgtcgacggtcgacggacacggaggtcggtgggtcggtcgggcgggtaaggcgttgtcgcggttaccgtcgttacgttcgaaccggtccgaacggtccgtcccggtcccgttcgtccgttccttccccg

SEQ ID NO: 376555 - DNA, 677 bp, Homo sapiens
  misc_feature: GZ8MTXP01DYAOD.11.12.B01.1.454.CMB.2.raw
  modified_base (213)..(213): a, c, t, g, unknown or other
  modified_base (219)..(219): a, c, t, g, unknown or other
  modified_base (574)..(574): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctcatcgtccgtcgtccccgganacgacncgccacatcagctcgtctcgtagggatagttcgttacttgtaactaagtggaagttatcgtcttaccgttaggtactcgagcgaaggaacggccacgggccccaaccgtcccccttagtccctacgttctactttacctttaacgaaaactccggaccggtccccgtacccgttcggtcggggtccctgaacgtctccgttccggcccgtctccggacttcggacggtacacgatcctacgtctacgacacgtcgacggacccggaccgttacgatttaacgtgtaacggggttcgtaaggttccgtttacgtccttacccgtttgtaccggttacggcggtcggtaggtaaccncggttaagggtcgttaggggtcgttcgggacgggtaccgaacggttcgttacgttcgggtaccgttaacggttccggcaccgggtaacccggaagttcccccg

SEQ ID NO: 376556 - DNA, 643 bp, Homo sapiens
  misc_feature: GZ8MTXP01AV0JU.11.12.B01.1.454.CMB.2.raw
  modified_base (215)..(215): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctcatcgtcccgtcgtcccccgganagaccacgccaccatcgagctgctcgtggatatgttctagaactaatgatatcgtcttcgtggtactcgagacgaggacggcacggcccaccgccccttgtaccctactctacttacttaacaaacgtccgacggtccccccgtccgtcggtccgggtaccctggaaaccgtcgtcgttcccgtacccgggtccgtaccccggtcgttaccggaacgggtaaaccctactacgttacccacgttaccgaccggtacctaacgtccggaaccggtcccgggaacctaggtcttaagtcggagtcggacgttctcgttactgttcgtagtccggaggtccgtagacctagcggtgttcgggtcgccggagggcgttaccgttgttcccgtaacggtcgttcgtacgggcttaccggccgttaacgccccg

SEQ ID NO: 376557 - DNA, 525 bp, Homo sapiens
  misc_feature: GZ8MTXP02IMK9K.11.12.B01.1.454.CMB.2.raw
  modified_base (210)..(210): a, c, t, g, unknown or other
  modified_base (349)..(349): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatgtccgtgtccccgganagacagccacatcagctgctctggagatgtcttgactaatgagtatgcttcctggtatcagcagaaggcaggcccagccccctgtccctactcatctttacaaactaccaggcccgccctcgtcggggtccctgagcgnttcctcccggctcccgctcgtgggaaccacgagtcactctgaccatcacgcggacccagctattgatgagtctgtctacttctgtcgaggcgtagggacaacgagtcggtggtcggttcgggcggtacgggaccgagtccgtgtacccgtcgttacggtcacgcccgaaggtcccg

SEQ ID NO: 376558 - DNA, 558 bp, Homo sapiens
  misc_feature: GZ8MTXP02H6M6V.11.12.B01.1.454.CMB.2.raw
  modified_base (447)..(447): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctcgtggagatgtcttgactaatgagtatgtcttcctggtatcagcagaaggcaggccagccccctgtccctactcatctttacaaaataccgaggccgccctcgtcggggtccctgacgcgtattccgccggctccggctcgtagggaacacgagtccactctcgaccatcgacgcgggacccaggctatgagtgaggtctgtcttacttctgtcgagggcgtggaacaacgngcggtggtcggtcgggacgggtacggaccgtagtcgtcggtaccgttcgtttacgggccgacgaacccgaacggcccgtcccggcccccgttacgggtcctaccgttcccg

SEQ ID NO: 376559 - DNA, 539 bp, Homo sapiens
  misc_feature: GZ8MTXP02GO91O.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaagcaggccagccccctgtccctactcatctttacaaaatcccaggccggccctcgtcggggtcccctggacgcgtacttccgtccggctcccggctcgtcggggaaacacgagtccactctacgaccatcacgccgggacccaggctatgatgagctgtctacttctgtcagggcgtgggacaacgaggcgtgggtgtcgggcggtacgggacctaggtctcggaccgtcgttacggtcacggcccgaaggccgtcggcccccgtcggtcctacttccg

SEQ ID NO: 376560 - DNA, 535 bp, Homo sapiens
  misc_feature: GZ8MTXP02JFX6E.11.12.B01.1.454.CMB.2.raw
  modified_base (212)..(212): a, c, t, g, unknown or other
  modified_base (356)..(356): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaggcaggccacgccccctgtccctactcatcctttacaaaataccgaggccccgccctcgtcggggtccctggacgcgnttccgtccggctcccggctcgtagggaaccacacgtcactctagacccatcgacgccggaccagctatgatgagctgtctacttctgtcagggcgtgggacacgagtcggtggtcggttcgggcggtacgggacctagtcgtggtacccgttcgttacggccacgccccgaaggtcccg

SEQ ID NO: 376561 - DNA, 519 bp, Homo sapiens
  misc_feature: GZ8MTXP02G8M3J.11.12.B01.1.454.CMB.2.raw
  modified_base (333)..(333): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttctggtatcagcagaaggcaggccagccccctgtcctactcatctttacaaaatccaggcgccctcgtcggggtccctgacgcgattcnccggctccggctcgtgggaacacgagtcactctcgaccatcgacgccgggacccaggctatgatgagctgtcttacttcgtgtcgaggcgtggacacgagcgtggtgtcggcggacgggccgagtcgtggaccgttcgtacggtcgacgtccgaacggcctccggcccccgtcggtccacgttccg

SEQ ID NO: 376562 - DNA, 533 bp, Homo sapiens
  misc_feature: GZ8MTXP02IRF1P.11.12.B01.1.454.CMB.2.raw
  modified_base (194)..(194): a, c, t, g, unknown or other
  modified_base (364)..(364): a, c, t, g, unknown or other
  modified_base (439)..(439): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttctggtatcagcagaaggcaggccagcccctgtcctactcatctttacaaatacccgaggccgccctcgtcggggtccctggacgcgtattccgtccggctccggctcgtcgggaacacngtcactctgaccatcgacgcggacccgagctatgagtgagtctagtctacttcgtgcgagggcgtgggacaacgnggcggtggtggtcgggcggtacgggccgagtcgtcgtaccgtcgttacggtccacggccgaacggccgtcggcccccgtcggtcctacgtcccg

SEQ ID NO: 376563 - DNA, 543 bp, Homo sapiens
  misc_feature: GZ8MTXP02JUV3Z.11.12.B01.1.454.CMB.2.raw
  modified_base (194)..(194): a, c, t, g, unknown or other
  modified_base (248)..(248): a, c, t, g, unknown or other
  modified_base (339)..(339): a, c, t, g, unknown or other
  modified_base (440)..(440): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttccnggtatcagcagaaggcaggccacgccccctgtccctactcatctttacaaaatcccaggccgccctcgtcggggtccctgacgcgattccnccggctccggctcgtgggaacacagtcactctgaccatcacgccgggacccaggctagttgatgaggtctgtcttacttctgtcagggcgtgggacaacgnggtcggtgggtcggtcgggcgggtacgggacctaggtcgtcggaccgttcgtacggtcacggcccgaacgggcctccggtcccccgtcggtccgtacgttccg

SEQ ID NO: 376564 - DNA, 528 bp, Homo sapiens
  misc_feature: GZ8MTXP02JX07V.11.12.B01.1.454.CMB.2.raw
  modified_base (355)..(355): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggcccagccccctgtccctactcatctttacaaaataccaggccccgccctcgtcggggtccctggacgcgnttccgtccggctccgggctcgtgggaaccacagtccactctgacccatcagcaggacccaggctatgatgaggctgtctacttctgtcagggcgtgggacacgaggcggtggtcgttcgggcggacggggaccaggtcgtcggtaccgtcgttacggtccacggtcccaacgg

SEQ ID NO: 376565 - DNA, 554 bp, Homo sapiens
  misc_feature: GZ8MTXP02GYT71.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccagccccctgtccctactcatctttacaaaatccaggccgcctcgtcggggtccctgacgcgtattcgtccggctccggctcgtgggaacacagtccactctgaccatcacgccggaccagtctatgatgagctgtctacttctgtcgagggcgtacggacaacgaggtcggtgggtcggtcgggacgggacgggaccctaggtccgtacggtaccggttacgttacgggccacggaaccccgaaacggtcccgtccggccccccgttcggtccctaccgttcccg

SEQ ID NO: 376566 - DNA, 578 bp, Homo sapiens
  misc_feature: GZ8MTXP02IA89B.11.12.B01.1.454.CMB.2.raw
  modified_base (193)..(193): a, c, t, g, unknown or other
  modified_base (387)..(387): a, c, t, g, unknown or other
  modified_base (469)..(469): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctcatgtccgtgtcccccgganagacagccacatcagctgctctggagatgtcttgactaatgagtatgcttctggtatcagcagaggcaggcccacgccccctgtccctactctatctttacaaaactccgaggccgccctcgtcggggtcctggacgcgtacttccgccggctcccggctcgtacgggaacacgagtccactctacgaccctanccgacggccgggaacccaggtaccttagttgagtggacggtctgttcttacttcgttgtcgagggtcgtagggaacaacggnggcggttgggtcggttcggggacgggtacgggaccgtaggtcgtacggtaccgttcgtacggtcacggaacccgtacggccgtccggtcccccgtcggtcctcttcccg

SEQ ID NO: 376567 - DNA, 507 bp, Homo sapiens
  misc_feature: GZ8MTXP02HTV6N.11.12.B01.1.454.CMB.2.raw
  modified_base (334)..(334): a, c, t, g, unknown or other
  modified_base (339)..(339): a, c, t, g, unknown or other
  modified_base (366)..(366): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtccccccggacagacagccaccatcagctgctctggagatgtcttgactaaatgagtatgcttcctggtatcagcagaaggcaggccagccccctgtcctactcatctttcaaaataccaggcgcctctggggtccctgacgcgattcnccggntcccggctctgggaacacagtcactcngacccatcagcgggacccaggctattgatgaggctgtctacttctgtcaggcgtgggacaacagcgtggtgttcggcgggacggaccaggtcctggaccgtcgttaggtcagcccaaggctcgccccctcggtccacttcc

SEQ ID NO: 376568 - DNA, 540 bp, Homo sapiens
  misc_feature: GZ8MTXP02FN2UF.11.12.B01.1.454.CMB.2.raw
  modified_base (456)..(456): a, c, t, g, unknown or other
tcagcgagagataccacgaccggtgctcgatttagtagtgtagatttgggtttgaggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccatcagtcacacctacatgagttgggtccgccaggctccgaggggaaggggctggagtgggtctcctttattacagcagtgtacgtacatattccgcagactccgtgaggggccattcaccatctccagacgacaactctaaagaacacgtctgtttctacaaatgaaacagcctgagagccgatgacncggccgtgtattactgtcgcgagagacgtcggggcccaacggaacgttacaacgctagtcggacgtcgtcggggccaaacgggg

SEQ ID NO: 376569 - DNA, 547 bp, Homo sapiens
  misc_feature: GZ8MTXP02I7MA5.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaggcaggccacgccccctgtccctactcatcttacaaatccaggcccgccctcgtcggggtccctgacgcgtattccgtccggccttccggctcgtagggaaccacagtccactctacgaccatccacgccggacccaggctagtgatgagtctgtctacttctgtcgaggcgtagggacaacgacggtcggtgggtcggttacgggcgggacggggacctggtcgtcggtacccgttcgttaacggccgacggtacccgaacggtcccg

SEQ ID NO: 376570 - DNA, 574 bp, Homo sapiens
  misc_feature: GZ8MTXP02HUAMC.11.12.B01.1.454.CMB.2.raw
  modified_base (224)..(224): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtccccccggacagacagccaccatcagctgctctgganatgtcttgactaatgagtatgcttcctggtatcagcagaaggcaggcccacgccccctgtccctactcatctttacaaaatcccaggccgccctcgtcggggtccctgacgcgacttccgccggctcccggctcgtagggaaaccacgagtccactctcgaccatcgacgccgggacccaggtactagttgagtgagctgtctacttctgtcgagggcgtaggacaacgaggcggttaggtggtcgggacggggtacggaccgtaggtccgtacggtaccgttcgtttaacggccgacggaaccccgaagggcccttcccggcccccgttaccggtcctaccgtttcccg

SEQ ID NO: 376571 - DNA, 528 bp, Homo sapiens
  misc_feature: GZ8MTXP02IG3E4.11.12.B01.1.454.CMB.2.raw
  modified_base (365)..(365): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtccccggacagacagccaccatcagctgctctggagatgtcttgactaatgagtatgcttcctggtatcagcagaaggcaggccagccccctgtccctactcatctttacaaaataccaggcgccctcgtcggggtccctggacgcgtattccgtccggctccggctcgtagggaacacngtcactctgaccatcagcgggacccaggctattgatggagctgtctacttcgtgtcagggcgtgggaacaacgaggtcggtggtggtcgggcgggtagggaccaggtctcggaccgttcgtacggtcacgtcccgaaggcctcggccccctcggccactcccg

SEQ ID NO: 376572 - DNA, 551 bp, Homo sapiens
  misc_feature: GZ8MTXP02HHUHB.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccggacagacagccaccatcagctgctctggagatgtcttgactaatgagtatgcttcctggtatcagcagaaggcaggccacgccccctgtccctactcatctttacaaaatcccaggccgccctcgtcggggtccctggacgcgtattccgccggctccggctcgtgggaacacgagtccactctcgaccatcgacgccggacccaggctatgatgagctgtcttacttctgtcagggcgtggacacgaggcggtggtggtcgggacgggacgggaccgtaggtcgtacggtacccggttcgttacgggtccacggcccgaacgggcctccggcccccgttcgggtcctaccgtttcccg

SEQ ID NO: 376573 - DNA, 543 bp, Homo sapiens
  misc_feature: GZ8MTXP02IVEZ1.11.12.B01.1.454.CMB.2.raw
  modified_base (212)..(212): a, c, t, g, unknown or other
  modified_base (239)..(239): a, c, t, g, unknown or other
  modified_base (342)..(342): a, c, t, g, unknown or other
  modified_base (349)..(349): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtcttgactaatgagtatgcttcctggtatcagcagaaggcaggccagccccctgtcctactcatcttacaaataccaggcccgccctcgtcggggtcccngacgcgnttcctccggctccggctcgtagggaacacagtcactctgaccatcagcggaccagctatgatgagctgtctacttctgtcaggtcgttaggacaacgagcggttgggtcggttcgggacgggtacgggaccgtacggttccgtaacggtaaccggttcgttaacgggtccgaacggaccccgtaaggtccccgg

SEQ ID NO: 376574 - DNA, 649 bp, Homo sapiens
  misc_feature: GZ8MTXP02J1UOQ.11.12.B01.1.454.CMB.2.raw
  modified_base (218)..(218): a, c, t, g, unknown or other
  modified_base (252)..(252): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtcccgtgtcccccccggaanacgacacgcccacatcagcctgctcgtgggagtntgttcttagaacttaatgtagtatcgtccttccgtggtactcgagcgaaggaacggcacggcccaccgtccccctcgtaccctactctacttacttaacaaaacgtccgacggcccccgtccctcggtcggggtccctggacgtcgtctccgtcccggaccgtccggtctcgtacgggaaccacgtacgtacctacgtctacgacccacgtaccgacgggacccgggtacccgacggtacttagttacggtagtcggtacgtcgttcgttacgttacgttcgttacggtcgtacggtacggtacggacgaacgtacggtcggtcgggtcgggtcgggacgggacgggaccgtacgtaccgtcggtaccgtacgttacgtacgacgaccgtacgtccg

SEQ ID NO: 376575 - DNA, 540 bp, Homo sapiens
  misc_feature: GZ8MTXP02ILYEQ.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccggacagacagccaccatcagctgctctggagatgtcttgactaatgagtatgcttcctggtatcagcagaaggcaggcccacgccccctgtccctactcattctttacaaaatacccaggccgccctcgtcggggtccctgacgcgattcgtccggctcccggctcgtgggaacacgagtccactctcgaccatccgagccggaccaggctattgatgagctgtcttacttctgtcgagggcgtggacaacgaggtcggtggtggtcgggcggacggaccaggtcgtcggaccgttcgttacggtcacgaaccgacggcctccggccccgttcggtcctacgtttcccg

SEQ ID NO: 376576 - DNA, 585 bp, Homo sapiens
  misc_feature: GZ8MTXP02GX4YX.11.12.B01.1.454.CMB.2.raw
  modified_base (414)..(414): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagccaccatcagctgctctggagatgtcttgactaatgagtatgcttctggtatcagcagaaggcaggccacgccccctgtcctactcatcttacaaaatccaggcccgtccctcgtcggggtccctggacgcgtacttccgtcccggcttcccggctcgtacgggaaaccacgacgttccactctcgaacctacnccgacggcccgggaacccagggtccttaagttgaagttggacggtcttaggtacttacgttagtcgtacgaggtcggtagggacaaacggcggtcggtgggtcggtcgggacgggacggaccgtaggtcgtaacggtaccgttacgtacggacaccggacccgacggtccg

SEQ ID NO: 376577 - DNA, 585 bp, Homo sapiens
  misc_feature: GZ8MTXP02J0UUC.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttctggtatcagcagaaggcaggccagccccctgtccctactcatctttacaaaactccaggccgccctcgtcggggtcccctggaccgcgtattccgtcccggctccggctcgtacggggaaaccacgagtccactctacgacccatcgacggccgggacccagggctagttgatggagtctgtcttacttctgtcgagggtcgtgggacaacgaggtcggttgggtggttcggggcgggtacggggaccgaggtccgtacggtacccggttcgttacgggtccacggaaccccgaacgggtcccgtcccggtcccccgttcggtaccctaccgtttcccg

SEQ ID NO: 376578 - DNA, 516 bp, Homo sapiens
  misc_feature: GZ8MTXP02JI972.11.12.B01.1.454.CMB.2.raw
  modified_base (349)..(349): a, c, t, g, unknown or other
  modified_base (434)..(434): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttacaaaataccaggcccgcctcgtcggggtccctgagcgnttccgccggctccggctctcgggaaccacacgtcactctcgacccatccgagccggacccaggctatgatgagctgtctacttcngtcaggcgtgggacaacgcgcggtggtcgtcggacggacggaccgagtcgtcgtaccgtcgttacggcacgaccgacgtccg

SEQ ID NO: 376579 - DNA, 544 bp, Homo sapiens
  misc_feature: GZ8MTXP02G72DU.11.12.B01.1.454.CMB.2.raw
  modified_base (194)..(194): a, c, t, g, unknown or other
  modified_base (337)..(337): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttctggtatcagcagaaggcaggccacgccccctgtccctactcatcttaacaaaatccgaggcgccctcgtcggggtcctgacgcgtattccnccggctccggctcgtagggaaacacgagtccactctacgaccatcgacggccggacccagtctagttgagtgagctgtcttactctgtcgagggcgtaggacaacgagcggtggtcggtcgggacgggtacggacctagtcgtacggtaccgttcgtacggtcgaacgcccgtaaggccgtccgacccccgtcggtctaccgttccg

SEQ ID NO: 376580 - DNA, 533 bp, Homo sapiens
  misc_feature: GZ8MTXP02IXSBS.11.12.B01.1.454.CMB.2.raw
  modified_base (367)..(367): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttacttcacagaatccatggcctcctatgagttgactcagccaccctccatgtccgtgtcccccggacagacagccaccatcagctgctctggagatgtcttgactaatgagtatgcttctggtatcagcagaaggcaggccagccccctgtcctactcatctttacaaaatccaggcgccctcgtcggggtccctgacgccgattccgtccggctccggctcgtgggacacagtcactcngaccatcagccggaccaggctattgatgagctgtctacttctgtcgcggcgtggaacaacgagtcggtaggtggttcggggcggacgggaccgaggtcgtcgaccgttcgtacggtcgacgcccgaacggcctccggcccccttcggtacccactccgtttcccgg

SEQ ID NO: 376581 - DNA, 561 bp, Homo sapiens
  misc_feature: GZ8MTXP02HJVNL.11.12.B01.1.454.CMB.2.raw
  modified_base (194)..(194): a, c, t, g, unknown or other
  modified_base (221)..(221): a, c, t, g, unknown or other
  modified_base (364)..(364): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtcttgactaatgagtatgcttctggtatcagcagaaggcaggccacgccccctgtcctactctattctttacaaaactccgaggccgccctcgtcggggtcctgacgcgtattccgccggctccggctcgtagggaaacncacgtcactcgtacgaccatcgacggccggaccagctagtgagtgagcttgtcttacttcgtgtcgagggcgtgggacaacgaggtcggttgggtcggttcgggacgggacgggaccgtaggtccgtaggtacccgttacgtacggtacgaccggcccgaacggtccttccgcccccgtcggtacctaccgttcccg

SEQ ID NO: 376582 - DNA, 508 bp, Homo sapiens
  misc_feature: GZ8MTXP02FI2IM.11.12.B01.1.454.CMB.2.raw
  modified_base (433)..(433): a, c, t, g, unknown or other
  modified_base (457)..(457): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtccctactcatctttcaaaatccaggcggccctcgtggggtcccctgacgcgattctccggctccggctcgtgggaacacagtcactctgacccatcagcgggacccaggctattgatgaggctgtctacttctgtcgagggcgtgggacaacgngcgtggtggtcgggcggacggacngtcgcgaccgtcgtacggcacgcccgaggctccgccccgtcggtccactcg

SEQ ID NO: 376583 - DNA, 512 bp, Homo sapiens
  misc_feature: GZ8MTXP02HT2HK.11.12.B01.1.454.CMB.2.raw
  modified_base (212)..(212): a, c, t, g, unknown or other
  modified_base (352)..(352): a, c, t, g, unknown or other
  modified_base (457)..(457): a, c, t, g, unknown or other
  modified_base (483)..(483): a, c, t, g, unknown or other
tcagcgagagataccacgaccggtgctcgatttagtagtgtagattccgcggggtggaagaacctgcccagcctgggcctcaggaggcagcatcggaggtgcctcagccattgcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccagccccctgtccctactcattcttacaaaatccaggcccgccctcgtcggggtccctgacgcgtnttctccggctcccgggctcgtagggaaccacagtccactctcgaccatcacgcggacccaggctagttgatgagtctgtctactctgtcgaggcgtggacaacgngcgtggtgtcggcggacggcagtcgngccgtcgttacggctacgcccgagtcccg

SEQ ID NO: 376584 - DNA, 519 bp, Homo sapiens
  misc_feature: GZ8MTXP02JZRKB.11.12.B01.1.454.CMB.2.raw
  modified_base (417)..(417): a, c, t, g, unknown or other
  modified_base (437)..(437): a, c, t, g, unknown or other
  modified_base (461)..(461): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccggacagacagccaccatcagctgctctggagatgtcttgactaatgagtatgcttcctggtatcagcagaaggcaggccagccccctgtccctactcatcttacaaaactccaggccgccctcgtcggggtcccctggaccgcgattcgtcccggctccggctcgtgggaacacagtcactctgaccatcagccggaccaggctagtgatgaggctgtcttactntgtcaggcgtggacaacggngtcggtggtgtcggcggacggacngtcgtcgtaccgtcgtacgcgacgcccgacggccctccgccccgtcgtcctacgtccg

SEQ ID NO: 376585 - DNA, 575 bp, Homo sapiens
  misc_feature: GZ8MTXP02HI1N8.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtccccccggacagacagccaccatcagctgctctggagatgtcttgactaatgagtatgcttctggtatcagcagaaggcaggcccagccccctgtccctactcatctttacaaaactaccaggccgccctcgtcggggtccctgacgcgtattcctccggctccggctcgtcgggaaacacgacgtccactctacgaccatccgacggccgggaacccaggtctagttgatgacggtctgtcttactttcgtgtcgagggcgtgggaacaacgaggtcggtggtggtcgggacgggacgggacccgtaggtccgtcggtacccgttcgttacggtccacgtaacccgaacgggtccgtcccggcccccgtcggtccctaccgtttcccg

SEQ ID NO: 376586 - DNA, 607 bp, Homo sapiens
  misc_feature: GZ8MTXP02H082W.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtgtcccccgganagacagccaccatcagctgctctggagatgtcttgactaatgagtatgcttctggtatcagcagaaggcaggccacgccccctgtcctactcatctttacaaaactccaggccgccctcgtcggggtccctgacgcgtattccgccggctcccggctcgtgggaacacgagtcactctcgacccatcgacggccggggaacccagggtaccttagttcgaagtcggaggcttacgttccttactttcgtaggttccgagggtccggtaggggaactaacggtaggtcggttggggttacggttcggggcgggtacggggacccgtaggtccgtacggtacccggttcgttaacggtccgaacggaaccccgtaaggtcccgtccggtccccccgtcggtcctaccgttcccg

SEQ ID NO: 376587 - DNA, 592 bp, Homo sapiens
  misc_feature: GZ8MTXP02JJ9NO.11.12.B01.1.454.CMB.2.raw
  modified_base (478)..(478): a, c, t, g, unknown or other
  modified_base (582)..(582): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccaccatcagctgctctggagatgtcttgactaatgagtatgtcttcctggtatcagcagaaggcaggcccacgccccctgtccctactctattcttacaaaactcccgaggccgtccctcgtcggggtccctgacgcgtattccgccggtctccggctcgtacgggaaacacgacgtcctactcctacgaccctatccgacgggccgggacccgaggtcttagtgaatggacgtcttgtccttacgttcgtgtcgacgggtcggtacggacaacgnggtcgtgggtcggtcgggacgggacggacccgtaggtcgtacggtacccgttcgtacggtcgacggtaacccgaacggtcctcccggtcccccgtcggtacccncgtttccccg

SEQ ID NO: 376588 - DNA, 569 bp, Homo sapiens
  misc_feature: GZ8MTXP02JDQKG.11.12.B01.1.454.CMB.2.raw
  modified_base (370)..(370): a, c, t, g, unknown or other
tcagcgagagataccacgaccggtgctcgatttagtagtgtagattccgcggggctgggactcaggaggcagcatcggaggtgcctcagccatggcatggatccctctcttcctcggcgtccttgcttactgcacagaatccatggcctcctatgagttgactcagcccaccctccatgtccgtgtcccccggacagacagccaccatcagctgctctggagatgtcttgactaatgagtatgcttctggtatcagcagaaggcaggcccagccccctgtccctactcatcctttacaaaatacccaggccgccctcgtcggggtcccctggaccgcgtacttccgccggctcccggctcgtgggaaacncagtccactctagaccatcacgcgggacccaggctatgatgagcttgtcttacttctgtcgaggtcgtacgggaacaacgaggtcgtgggtcggttcgggcgggtacggggacctaggtccgtacggtaaccggttcgttaacggccgaacggaacccgaacggtccgtccggtcccccgtcggtcctaccgtttcccg

SEQ ID NO: 376589 - DNA, 567 bp, Homo sapiens
  misc_feature: GZ8MTXP02GZJEX.11.12.B01.1.454.CMB.2.raw
  modified_base (351)..(351): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaggcaggccacgccccctgtcctactcattcttacaaaatccgaggcccgccctcgtcggggtccctgacgcgnttccgccggctcccgctcgtcgggaaacacagtccaacctctcgacccatccgacggcccgggacccaggtctaagttgaatggaggcttagtccttaacgtctacgtcgagggtcgtacgggaacaacgaggtcggtagggttcggtccggggacggacgggacccgtagtccgcgtacccgttcgttacggaccgacggaccccgaaggtcccg

SEQ ID NO: 376590 - DNA, 592 bp, Homo sapiens
  misc_feature: GZ8MTXP02HL65M.11.12.B01.1.454.CMB.2.raw
  modified_base (194)..(194): a, c, t, g, unknown or other
  modified_base (248)..(248): a, c, t, g, unknown or other
  modified_base (298)..(298): a, c, t, g, unknown or other
  modified_base (361)..(361): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctcgtggagatgtcttgactaatgagtatgcttccnggtatcagcagaaggcaggcccacgccccctgtcctactctatctttaanaaaatacaggccgcctcgtcgggtccctgacgcgtacttcgcggctccggctcgtagggaacncacgtccactctacgaccatccgacgccgggacccgaggtctagttgagtgagtctgtccttacttcgtgacgacgggtcggtacgggaacgaaccggtaggtcgggttacgggttcgggttcgggggaccgggtaacggggacccgtaggtccgtacggtaccgtttacgtacggtaccgacggaacccgtaaggcccgtacccgtccccgtacggtccctacttccccg

SEQ ID NO: 376591 - DNA, 570 bp, Homo sapiens
  misc_feature: GZ8MTXP02JP9PG.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccgganagacagccaccatcagctgctctggagatgtcttgactaatgagtatgcttcctggtatcagcagaaggcaggccacgccccctgtccctactcatctttacaaaatcccgaggccgccctgtcggggtccctgacgcgtattcgccggctccggctcgtcggggaaacacgagtcactctacgaccataccgagccgggaccaggctatgatgagctgtcttacttcgtgtcgagggcgtagggacaacgacggtcggtagggttcggttcggggcggggacgggaccacggttccgtacggtaccgttcgttaacggtccgacgaaccccggaaggtccctccggcccccgttcggtcctaccgtttccccg

SEQ ID NO: 376592 - DNA, 522 bp, Homo sapiens
  misc_feature: GZ8MTXP02JS8ZC.11.12.B01.1.454.CMB.2.raw
  modified_base (349)..(349): a, c, t, g, unknown or other
  modified_base (365)..(365): a, c, t, g, unknown or other
  modified_base (378)..(378): a, c, t, g, unknown or other
  modified_base (428)..(428): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaggcaggccagccccctgtcctactcatctttacaaaatccaggcccgccctcgtcggggtccctgacgcgnttccgccggctccggntcgtgggaacacngtcactctgaccatcacgcggacccagctagtgatgagctgtctacttcngtcgaggcgtgggacaacgcggcggtggtcggtcggacgggacggacctagtcgtaacggtaccgttcgtacggtacgacggacccgacggccg

SEQ ID NO: 376593 - DNA, 566 bp, Homo sapiens
  misc_feature: GZ8MTXP02GFKS3.11.12.B01.1.454.CMB.2.raw
  modified_base (198)..(198): a, c, t, g, unknown or other
  modified_base (358)..(358): a, c, t, g, unknown or other
  modified_base (467)..(467): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtccccccgganagacagccaccatcagctgctctggagatgtcttgactaatgagtatgcttcctggtatcagcagaaggcaggccacgccccctgtccctactcattctttacaaaactccgaggccgccctcgtcggggtccctggacgcgtacttcgccggctccggntcgtgggaacacgagtccacgtctacgacctatcgacggccgggacccaggtactagttgatggacggtctcgtacttacttcgtgtcgagggtcgtacgggacaacgnggtcggtggtggtcgggcgggtacggaccgaggtcgtcggaccgttcgtacggtcgacgaacccgtacggcctccgcccccgtcggtcctacgttcccg

SEQ ID NO: 376594 - DNA, 576 bp, Homo sapiens
  misc_feature: GZ8MTXP02FG4JS.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtccctactcatctttacaaaataccaggccggtccctcgtcggggtcccctgacgcgtattccgtccggctccggctcgtggggaaacacgagtcactctcgacccatccacggcgggacccaggctattgatgaggctgtctacttcgtgtcgagggcgtacgggacaacgaggtcggtgggtcggttcggggacgggacggggacccaggtccgtacggtacccgttcgttaacgggtccaacggccccgaaagggtccctccggccccccgttcgggtaccctaccgtttccccg

SEQ ID NO: 376595 - DNA, 551 bp, Homo sapiens
  misc_feature: GZ8MTXP02HYN6X.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccagccccctgtcctactcatctttacaaaatccaggcgccctcgtgggccctgacgcgtatcgccggctccggctcgtgggaacacagtccactctcgaccatccgacgccgggacccagggactagttgattggagtctgttcttacgttcttgtcgagggcgtaggacaacgtagcggtgggtcggttcggggcgggtacgggacccgtaggtccgtcggaacccgttcgtacggtcgacggcccgaaggcctccgcccccgtacggtccctacgttcccg

SEQ ID NO: 376596 - DNA, 529 bp, Homo sapiens
  misc_feature: GZ8MTXP02H1GSN.11.12.B01.1.454.CMB.2.raw
  modified_base (192)..(192): a, c, t, g, unknown or other
  modified_base (283)..(283): a, c, t, g, unknown or other
  modified_base (374)..(374): a, c, t, g, unknown or other
  modified_base (397)..(397): a, c, t, g, unknown or other
  modified_base (399)..(399): a, c, t, g, unknown or other
  modified_base (404)..(404): a, c, t, g, unknown or other
  modified_base (414)..(414): a, c, t, g, unknown or other
  modified_base (419)..(419): a, c, t, g, unknown or other
  modified_base (431)..(431): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagccaccctccatgtccgtgtccccgganagacagccaccatcagctgctctggagatgtcttgactaatgagtatgcttcctggtatcagcagaaggcaggccagccccctgtcctacncatcttacaaaatccaggcgcctcgtcggggtcctgacgcgactttcgccggctccggactcgtacgggaaacacagtcactctgacccancagccgggacccaggctatgagngngtctntctactgtgngaggngtaggaacaagnggtcggtggtcggtcgggacgggacggacgacgtcgtacgtacgtacgtacgtacgacgaaccgacgaccgtccgtcccgtccgtaccgtaccgtccg

SEQ ID NO: 376597 - DNA, 512 bp, Homo sapiens
  misc_feature: GZ8MTXP02GGCPW.11.12.B01.1.454.CMB.2.raw
tcagcgagagataccacgaccggtgctcgatttagtagtgtagattccgcgggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagagcaggccaccccctgtcctactcatcttacaaaataccaggccgcctctcggggtcctgagccgattctccgctccggctcgtgggaacacgagtcactctcgaccatcgagcggacccaggctatgatgagctgtctacttctgtcagggcgtggacacgagcgtggtggttcgggcggtagggaccagtctcggaccgttcgttacggcgacgcccgaacggctcgcccccgtcggtccaccgtcttcccg

SEQ ID NO: 376598 - DNA, 535 bp, Homo sapiens
  misc_feature: GZ8MTXP02HEG8V.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccaccatcagctgctctggagatgtcttgactaatgagtatgcttctggtatcagcagaaggcaggcccacgccccctgtccctactcatctttacaaaactcccaggccgccctcgtcggggtccctgacgcgacttcgtccggctccggctcgtagggaacacagtcactctcgaccatcgacgccgggaccaggctatgatgagctgtctacttcgtgtcgagggcgtacggacaacgaggcggtggtcggtcgggcgggtacgggaccaggtctcggtaccgtcgtacggtcacgtcccgaaggcctcgcccccgtcggtcctactcccg

SEQ ID NO: 376599 - DNA, 648 bp, Homo sapiens
  misc_feature: GZ8MTXP02G8CKG.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccaccatcagctgctctggagatgtcttgactaatgagtatgcttctggtatcagcagaaggcaggcccacgccccctgtccctactctattctttacaaaactcccgagggtccgcccctcgtcggggtcccctgaccgtcgtacttccgccggctccggctccgtgggaacacgagtccactctacgaccctagtaccgacgccggggaaccctagggaccttagttcgaagttcggaggtcttcggttccttacttcgtgtcgagggtccggtaggacaacgtcggtcggttcgggtggttccggggcgggtaacggggtcccgaaggttccgttaacggtacccggtttacgttaaccgggtacccgaaccgggtaacccgaaacgggtcccgttaccccgggtaccccccggtttaccgggtcccctaaccgtttcccccgg

SEQ ID NO: 376600 - DNA, 578 bp, Homo sapiens
  misc_feature: GZ8MTXP02H23CQ.11.12.B01.1.454.CMB.2.raw
  modified_base (213)..(213): a, c, t, g, unknown or other
  modified_base (242)..(242): a, c, t, g, unknown or other
  modified_base (352)..(352): a, c, t, g, unknown or other
  modified_base (430)..(430): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganacgacagccaccatccagctgctctgganatgtcttgactaatgagtatgcttcctggtatcagcagaggcaggcccagccccctgtcctactcattcttacaaataccaggcccgcctcgtcggggtccctgacgctnttccgtccggccgtccgcctcgtacggggaaaccaccgagtccactcctacgaccctagtccgacggccgggacccgnggctagttgagtgaggtctcggtacttacgttctcgttcgaggtcggtacggaacaacgtacggcggttagggtcggttccgggacgggtacggaccgtaggtcgtaacggtccgttacggtacggtcacgtacccgtacggtcccgg

SEQ ID NO: 376601 - DNA, 625 bp, Homo sapiens
  misc_feature: GZ8MTXP02FXLE8.11.12.B01.1.454.CMB.2.raw
  modified_base (197)..(197): a, c, t, g, unknown or other
  modified_base (471)..(471): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtgtccccccgganagacagccaccatcagctgctctggagatgtcttgactaatgagtatgcttctggtatcagcagaaggcacggcccacgccccctgtccctactctattcctttaacaaaactcccgaggcccggtaccccttcggtcggggtcccctggaccgtccgtacttccgtcccggtcctcccggctccgtagggaaaccacgacgtccactctcgaacccataccgacggaccgggacccaggtactagttgagtgacgtcttgttccttacttcgngttcgagggtcggtacgggaacaacgcggtcggtgggttcgggtcggggacgggtacggggaccctaggtcgtacggtaccgttcgttacggccgaacggaacccgtaacggcccgtacccggtccccccgttacggtaccctaccgtttcccg

SEQ ID NO: 376602 - DNA, 564 bp, Homo sapiens
  misc_feature: GZ8MTXP02JW6QP.11.12.B01.1.454.CMB.2.raw
  modified_base (355)..(355): a, c, t, g, unknown or other
  modified_base (421)..(421): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtcccgtgtccccccggacagacagccaccatcagctgctctggagatgtcttgactaaatgagtatgcttcctggtatcagcagaaggcaggccacgcccctgtccctactcatctttacaaaatccaggccccgccctcgtcggggtccctgacgcgnttccgccggccgtccggctcgtagggaaccacagtccactctcgacccatccacgccgggaacccnggcctaagttgatggagctgtctacttcgtagtcgacgggtcgtagggacaacggcggtcggtggtcgggtccgggacgggacggaccgtacgtccgtaacggtaccgttacggtacggtaccgaccggacccgacggtcccg

SEQ ID NO: 376603 - DNA, 559 bp, Homo sapiens
  misc_feature: GZ8MTXP02FJKNN.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccaccatcagctgctctggagatgtctgactaatgagtatgcttctggtatcagcagaaggcaggccacgccccctgtccctactcatctttacaaaactcccgaggccggccctcgcggggtccctggacgcgtactccgccggctccggctcgacgggaaacacgacgtcactctacgaccatcacgcggacccagctattgatgagctgtctacttctgtcgagggcgtagggacaacgaggcggtgggtcggttcggggacgggaacggggtacctaggtcgtacggtaccgttacgttacggtcgacggaacccgaaaggtcctccggcccccgtcggtcctaccgttcccg

SEQ ID NO: 376604 - DNA, 601 bp, Homo sapiens
  misc_feature: GZ8MTXP02G2SCN.11.12.B01.1.454.CMB.2.raw
  modified_base (193)..(193): a, c, t, g, unknown or other
  modified_base (220)..(220): a, c, t, g, unknown or other
  modified_base (576)..(576): a, c, t, g, unknown or other
tcagcgagagataccacgaccggtgctcgatttagtagtgtagattccgcggggctgggcctcaggaggcagcatcggaggtgcctcagccatggcatggatccctctcttcctcagcgtccttgcttactgcacagaatccatggcctcctatgagttgactcagccaccctcatgtccgtcgtccccgganagacagccaccatcagctgctctgganatgtcttgactaatgagtatgcttcctgtatcagcagaaggcacggccacgccccctgtccctactcaacttctttaacaaaaactcccacgggccggacccctcggtcggggtcccctgagtccgtattccgtccggcctccggctcgtacgggaaacacagtcaccgttctacgaccatcgacggccgggaacccgaggaccttagttgatacggaggtcttagtccttacgtttctcggtacgaggtcggtacggacaaacgcggtcggtcgggttggtcggggacgggtacgggaccctaggtccgtacggacccgttacgtacggtaccaaccggacccgaacgggtcccncccgtcccccgtcggtacctacccg

SEQ ID NO: 376605 - DNA, 538 bp, Homo sapiens
  misc_feature: GZ8MTXP02FRSBO.11.12.B01.1.454.CMB.2.raw
  modified_base (369)..(369): a, c, t, g, unknown or other
  modified_base (444)..(444): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagccaccatcagctgctctggagatgtcttgactaatgagtatgcttcctggtatcagcagaagcaggccagccccctgtccctactcatctttacaaaactacccaggccggcccctcgtcggggtcccctggacgcgattccgtccggctcccggctcgtgggaaacncgagtcactctgaccatcagcggacccagctattgatgagctagtctacttcgtgtcgagggcgtgggacaacgngtcgtggtggtcgggacggacggacgtgtcgtacggtaccgttcgttacggcgacgaaccgacggccgtcccgtccccgtcggtcctacgtccg

SEQ ID NO: 376606 - DNA, 690 bp, Homo sapiens
  misc_feature: GZ8MTXP02GPR6Y.11.12.B01.1.454.CMB.2.raw
  modified_base (399)..(399): a, c, t, g, unknown or other
  modified_base (480)..(480): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtgtccccccggacgacgacacgacccaacctactacgacgtctcgtccttcggtagggaagtagttcgttcgttacgtaacttaagtaggtaagttagtcgttccttccgttggtactcgagacaaggaacgcgacggccacccgtccccctcgtaccctactctacttccttaaacaaaactaccgacgggcccgtccctcggtccggggtcccnggaccgcgtacttccgccggccgtccgctcggacggaacacgtacgccactcgacgactcgtcgacgggcccggaacccgnggtacttagtacgtagtcgggacggttcttccggttacctttaccgttcgttggtacggacggggtcggtacggaactaacggtcggtcgggttgggttcggggtaccgggacggggacggaccgtagtccgtaacggtcccgtttaggttacgccgaccggaacccgtacggtcctccccggccccgttcggtacctaccgtttccccg

SEQ ID NO: 376607 - DNA, 549 bp, Homo sapiens
  misc_feature: GZ8MTXP02GOAID.11.12.B01.1.454.CMB.2.raw
  modified_base (384)..(384): a, c, t, g, unknown or other
  modified_base (392)..(392): a, c, t, g, unknown or other
  modified_base (463)..(463): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacacgccaccatcagctgctctggagatgtcttgactaatgatatgcttctggtatcagcagaagcacggccacgcccctgtcctactcattcttaacaaaactaccgacggcccgcccctcgtcggggtccctgacgctcttccgtccggctccggctcgaggacacngtcactcngaccatcgagccggacccaggctagttgagtgacgctgtcctacttgtgtcgacggtcgtagggacaacgnggtcggtggttcggtcggggacggacgggaccgtaggttccgtaacggtaccgttacgttacggccacggtcccgaacggtccccg

SEQ ID NO: 376608 - DNA, 548 bp, Homo sapiens
  misc_feature: GZ8MTXP02IYN1D.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccacgccccctgtccctactcatcttacaaatccaggccccgccctcgtcggggtcccctggacgcgtgttccgtcccgggccttcccgggcctcgtaggggaaaccacgagtccactctcgacccatccaggccgggacccaggctatgatgaggctgtctacttctgtcgagggcgtgggacaagacggtcggtggtcggtcggggcggtacgggaccaggtcgtcggaccggtcgttacgggtcacgcccgaaggtcccg

SEQ ID NO: 376609 - DNA, 555 bp, Homo sapiens
  misc_feature: GZ8MTXP02IF3O5.11.12.B01.1.454.CMB.2.raw
  modified_base (195)..(195): a, c, t, g, unknown or other
  modified_base (399)..(399): a, c, t, g, unknown or other
  modified_base (472)..(472): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccaccatcagctgctctggagatgtcttgactaatgagtatgcttctggtatcagcagaacggcaggcccacgccccctgtcctactcatctttacaaaactccgaggccgtccctcgtcggggtccctggacgtcgtacttccgtccggcttcccgggctcggtcgggaaacaccgtagtccacttctcgaacctancgacggccggaacccaggtctagttgagtcgagtctcgttcttacttcgtgtcgagggcgtacgggacaacgngtcggtggtcggtcgggacggacggacgagtacgtcggaccgttcgtacgcgacgccgacgctcgccccgtcgtccacgtccg

SEQ ID NO: 376610 - DNA, 561 bp, Homo sapiens
  misc_feature: GZ8MTXP02FH3DY.11.12.B01.1.454.CMB.2.raw
  modified_base (223)..(223): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagccaccatcagctgctctgganatgtcttgactaatgagtatgcttctggtatcagcagaaggcaggccacgccccctgtcctactctatctttacaaaatacccaggccggtccctcgtcggggtccctggacgcgtacttcgccggctcccggctcgtagggaacacgagtcactctgacctatcgacggaccggacccaggtctagttgagtgagtctgtctacttcgtgtcgaggcggtaggacaacgagcggtgggtggtcgggcgggacgggaccgtggtccgtacggtaccgttcgttacggctacggaacccgaacggtccgtcccggcccccgtcggtcctaccgttcccg

SEQ ID NO: 376611 - DNA, 660 bp, Homo sapiens
  misc_feature: GZ8MTXP02J2CWF.11.12.B01.1.454.CMB.2.raw
  modified_base (214)..(214): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagaccagccaccatcagctgctctggagtatgtcttgactaatgagtatgtcttctggtatcagcagaggcacggccacgccccctgtccctatctatcttaacaaaatccgacggccccgcctcgtcggggtccctgacgcgtctccgtccggctccggctcgtacgggaacacgtacgtaccaccgtcctacggaaccctacgtaccgacggaccggggaacccccaggtacctaagttgaacgtggacggtcttcggttccttacgttcgtaggttacccggaaggggtcccgttagggggaaaccaacggtacgggtcccggggttaggggttccgggttacggggaccgggggtaaccgggtacccgaacgggtttaccgcgggttaaccccggttcgtttaaacgggcccgtaaccggtaccccggaacggggtcccccg

SEQ ID NO: 376612 - DNA, 560 bp, Homo sapiens
  misc_feature: GZ8MTXP02HESO5.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttacttcacagaatccatggcctcctatgagttgactcagccaccctccatcgtcccgtcgtcccccggacagacagccaccatcagctgctctggagatgtcttgactaatgagtatgcttctgtatcagcagagcacggccacgccccctgtcctactcattcttacaaaatccaggccgccccctcgtcggggtccctgacgcgtattccgtcccgggctcccggtctccgtagggaaccacgacgtcacctctacgacccatccgacggccggaccaggctattgatgacggtctgtcttacttgtcgtcgaggcgtagggaacaacgtacggtcggtggtggttcgggcgggacgggaccgtacgtcgtacgaaccgttcgttacgcgtacgacccgaacggccgtcccgg

SEQ ID NO: 376613 - DNA, 552 bp, Homo sapiens
  misc_feature: GZ8MTXP02G0SX5.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcacggccacgccccctgtccctactctatcttacaaaactccaggcgccctcgtcggggtccctgacgcgtattccgccggcctccggctcgtcgggaacacgacgtccactctagacccatccacggccgggacccaggctagtgactgaggtctgtcttacttctgcgtagggcgtaggacacgaggcggttggtcggtacgggcgggtacgggacctaggtcgtacgaccgttctacggtccgacggaacccgacggcctcggcccccgtcggtacctcgttcccg

SEQ ID NO: 376614 - DNA, 552 bp, Homo sapiens
  misc_feature: GZ8MTXP02JLCQH.11.12.B01.1.454.CMB.2.raw
  modified_base (194)..(194): a, c, t, g, unknown or other
  modified_base (340)..(340): a, c, t, g, unknown or other
  modified_base (443)..(443): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttctggtatcagcagaaggcaggcccagccccctgtccctactcattctttacaaaatcccgaggccgccctcgtcggggtccctgacgcgattccnccggctccggctcgtgggaacacgagtcactctgacccatcacgcgggacccaggctatgatgagtctagtctacttcgtgtcgagggcgtagggacaacggnggtcggttgggtcggtcgggacgggtacggaccgtaggtccgtcggtaccgttcgtacggcgaccggaacccgacggtccctcccggcccccgtcggtacctacgtccg

SEQ ID NO: 376615 - DNA, 506 bp, Homo sapiens
  misc_feature: GZ8MTXP02ITQSH.11.12.B01.1.454.CMB.2.raw
  modified_base (341)..(341): a, c, t, g, unknown or other
  modified_base (345)..(345): a, c, t, g, unknown or other
  modified_base (427)..(427): a, c, t, g, unknown or other
  modified_base (442)..(442): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaggcaggccagccccctgtcctactcatcttacaaaatccagccgcctctggggtccctgagcnttcncggctccggctcgtagggaacacgacgtcactctgacccatcagcggacccagctatgatgagctgtctactctgtcgaggngtagacgaacgacgngtggtcggtcggacggacggacgacgtacgtaacgtacgtacgtacgtacgacgaccgacggcg

SEQ ID NO: 376616 - DNA, 606 bp, Homo sapiens
  misc_feature: GZ8MTXP02GSGVB.11.12.B01.1.454.CMB.2.raw
  modified_base (242)..(242): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtccccccggacagacagccaccatcagctgctctgganatgtcttgactaatgagtatgcttctggtatcagcagaggcacggccacgccccctgtaccctactctacttctttaacaaaactccgacggccccgtccccgtcgtcggggtccctggacgcgtcttccgtccgggctccggctcggtacggaacacgagtccactctcgacccatccgacggcccggaacccgaggtcttagtgtagtggtacggtcttcgttccttaccttcgtacgtcggtacggtcggtaggaacaacgtcggtcgggttgggttcggttcgggggacgggacgggtaccgtacggttccggtaacggtaccggttacgttacggccgaccggtaccgaacggtccccg

SEQ ID NO: 376617 - DNA, 507 bp, Homo sapiens
  misc_feature: GZ8MTXP02JEZDD.11.12.B01.1.454.CMB.2.raw
  modified_base (192)..(192): a, c, t, g, unknown or other
  modified_base (336)..(336): a, c, t, g, unknown or other
  modified_base (369)..(369): a, c, t, g, unknown or other
  modified_base (431)..(431): a, c, t, g, unknown or other
  modified_base (433)..(433): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccacctccatgtccgtgtccccgganagacagccaccatcagctgctctggagatgtcttgactaatgagtatgcttctgtatcagcagaaggcaggccagccccctgtccctactcactcttacaaaaatcccaggcggcccctcgtcggggtccctgacgtcgattcnccggctccggctcgtgggaacacagtcaactcngaccatcagcggacccaggctatgatgagtctagtctattctgtcagggctagggacaacgngngtggtgtcgcggacggacgacgcgtcgtacgtcgtacgtcgacgaacgacgacgtcgcccgtccgtcgtactcg

SEQ ID NO: 376618 - DNA, 585 bp, Homo sapiens
  misc_feature: GZ8MTXP02FRE3U.11.12.B01.1.454.CMB.2.raw
  modified_base (196)..(196): a, c, t, g, unknown or other
  modified_base (223)..(223): a, c, t, g, unknown or other
  modified_base (391)..(391): a, c, t, g, unknown or other
  modified_base (469)..(469): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccaccatcagctgctctgganatgtcttgactaatgagtatgtcttcctggtatcagcagaaggcaggccacgccccctgtcctactctatctttacaaaactccgaggccggtccctcgtcggggtccctggaccgtcgacttcgtccggcgtccggctcgtgggaactacacgtcactctacgaccngtacgacgaccggacccaggctagttgatgaggtcttcgtacttacgttcgtgtcgagggtcggtacggacgaacggnggtcggtggtcggtcggggacgggacggtaccgagtcgtacggtaccgttcgtacggtccgaccggaacccgtaacgggtcctcccggcccccgttcggtaccctaccgtttcccg

SEQ ID NO: 376619 - DNA, 553 bp, Homo sapiens
  misc_feature: GZ8MTXP02FUADM.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccacgccccctgtccctactcatctttacaaaatcccaggccggccctcgtggggtccctggacgcgtattcgccggctcccggctcgtgggaacacgagtcactctcgaccatcagccggacccaggctagttgatgagctgtctacttctgtcgaggcgtacgggacaacgagcggttggtcggttcggggcgggtacgggaccgtaggtcgtacggaccgttcgttacggtccgaacggcccgaaggcccgtaccggccccccgtcggtcctaccgtttcccg

SEQ ID NO: 376620 - DNA, 583 bp, Homo sapiens
  misc_feature: GZ8MTXP02JK1NT.11.12.B01.1.454.CMB.2.raw
  modified_base (196)..(196): a, c, t, g, unknown or other
  modified_base (225)..(225): a, c, t, g, unknown or other
  modified_base (252)..(252): a, c, t, g, unknown or other
  modified_base (348)..(348): a, c, t, g, unknown or other
  modified_base (393)..(393): a, c, t, g, unknown or other
  modified_base (467)..(467): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccgganagacagccaccatccagctgctcgtgganatgtcttgactaatgagtatgcttccnggtatcagcagaaggcaggccacgccccctgtccctactctatctttacaaaactaccgaggccgtcctcgtcggggtccctggacgcgtacttcncccggtctccggctcgtagggaacacgacgtcacgtctcgaaccntaccgacggccggacccaggctagttgaatggacggtcttgtccttacttcgtgtcagggcgtaggacaacggnggtcgtgggtcggtcgggacgggacggtacgtacggtcgtacggtaccgttacgtacggtccgacgtaacccgacgggtcccgtcccggtcccccgtacggtccctaccgttcccg

SEQ ID NO: 376621 - DNA, 736 bp, Homo sapiens
  misc_feature: GZ8MTXP02JOQYB.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttccttggcgtccttgcttactgcacagaatccatggcctcctatgagttgactcacgcccaccctccatcgtccgtcgtcccccggacacgacacgccaccatcagctgctcgtggagtatgtcttgactaatgtagtatgcttctggtatcagcagaaggcgacggcccacgtcccctgtcctactctacttcttaacaaaactacccgacgggccgtcccgtcggtcggggtccctggaccggtcgtacgttccgtcccgggtaccgtccgggtctccggtacggggaaaccaacgtaccgtcctaaccttcgtacgaaaccctacgtaccggaaccgggcccggggaaccctagggtaccttaggttgtaacgtgggacgtcgtttacgtccttacgttccgtgtaccggagggtcgggtacgggaacctaacggcggttacgggttggggttacggggttccgggggaacggggtaaccggggtacgtaacggttccggtaccggttaacccgggtttaccgttaacgggggttaccgaaccgggtaaccccggtaaccgggttcccgttcccccggttacccccggttccggggttaaccccttacccggttttcccccgg

SEQ ID NO: 376622 - DNA, 588 bp, Homo sapiens
  misc_feature: GZ8MTXP02JGX1O.11.12.B01.1.454.CMB.2.raw
  modified_base (242)..(242): a, c, t, g, unknown or other
  modified_base (358)..(358): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagccaccatcagctgctctggagntgtcttgactaatgagtatgcttctggtatcagcagaggcacggccacgccccctgtccctactcattcttacaaaactaccgaggccccgccctcgtcggggtccctgacgcgtnttccgtccggcgtccggctcgtacgggaacacgacgtcactcgtacgaccctagtccgacggccgggacccaggtcttaagttgagtggacggtcttgtcttacgttcgtgtcgaggtcggtagggaccaaggtcggtcggttgggtacggtcgggacgggtacgggaaccgtggtccgtcggtacccgttcggtttacgggaccaaccggtacccgaacggggtccccg

SEQ ID NO: 376623 - DNA, 652 bp, Homo sapiens
  misc_feature: GZ8MTXP02HHZUR.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccacgccccctgtccctactcatctttacaaaataccgacggccgccctcgtcggggtccctgacgcgtacttccgtccggctccggctcgtagggaacacgacgtcactctacgaccatccgacggccgggacccagggtaccttagtaggatggacggtcgttcgttccttactttcgttggtaccgtagggacggtacggggaacctaaacggcggtcgggttggggttcgggtttaccgggggaccggggtaacggggtacccgtaggttcccgtacggttacccgggttacgtttaacggggttccgaaccggtccccggtaagtttcccggggacccgttccccggtcccccccggttacgggttaccccttcccccgg

SEQ ID NO: 376624 - DNA, 546 bp, Homo sapiens
  misc_feature: GZ8MTXP02G4ES7.11.12.B01.1.454.CMB.2.raw
  modified_base (194)..(194): a, c, t, g, unknown or other
  modified_base (447)..(447): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctggagatgtcttgactaatgagtatgcttcctggtatcagcagaaggcaggcccagccccctgtccctactcatctttacaaaatccaggccgccctcgtcggggtccctgacgcgtattctccgggctcccggctcgtcgggaaccacgagtccactctcgacccatccgacggccgggacccaggctagtgatggagctagtctacttgtgtcgaggcgtaggacaacgngcgtggtcgtcgggcggtacgggacctaggtcgtcggaccgttcgttacgggtccacggcccgaaggtcccgtcgcccccgtcggtaccacgtttcccg

SEQ ID NO: 376625 - DNA, 637 bp, Homo sapiens
  misc_feature: GZ8MTXP02GJMY3.11.12.B01.1.454.CMB.2.raw
  modified_base (194)..(194): a, c, t, g, unknown or other
  modified_base (521)..(521): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctcgtggagatgtcttgactaatgagtatgcttctggtatcagcagaagcacggccacgccccctgtccctactctattcctttaacaaaactacccgagggtcccggtccccgttcgtcggggtcccctaggaccgtcgtacttccgtcccgggtcgtcccggctcgtacggggaaacacgtacgtccaactctacgaccacgtacgacggaccggggaccctagggtacttaagttgacgttaggacggtcttacggttccttacgttccgttagtccgaggggtacggtacggggaacctaacgngggtccggttgggtcgggtcgggacggggtacggaacctggtccgtacgtacgttccgttaacggccgtacgaacccgacgggtcctcccggccccgtttcggccctactttcccg

SEQ ID NO: 376626 - DNA, 597 bp, Homo sapiens
  misc_feature: GZ8MTXP02FOY36.11.12.B01.1.454.CMB.2.raw
  modified_base (397)..(397): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagaccagccaccatcagctgctctggagatgtcttgactaatgagtatgtcttcctgtatcagcagaaggcacggccacgccccctgtcctactcattacttacaaaatccgacggccccgtccctacgtcggggtccctggacgcgtacgtcctccggcctccggctcgacggggaacacgngtccacgtctacgaccagtacacgacgacggacccaggaccttagtgagtggacggtcttgtaccttacgttcgtcggtacgacgggcggtacgggacaaacgtgggtcggtgggtcgggttcgggacggggtacgggaccgtaggttaaccgtcggacccggtttacggtaccggtaccgacggtacccgtaaccgggg

SEQ ID NO: 376627 - DNA, 598 bp, Homo sapiens
  misc_feature: GZ8MTXP02JDOVN.11.12.B01.1.454.CMB.2.raw
  modified_base (196)..(196): a, c, t, g, unknown or other
  modified_base (250)..(250): a, c, t, g, unknown or other
  modified_base (369)..(369): a, c, t, g, unknown or other
  modified_base (387)..(387): a, c, t, g, unknown or other
  modified_base (472)..(472): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtcccgtgtcccccgganagacagccaccatcagctgctcgtggagatgtcttgactaatgagtatgcttcnggtatcagcagagcaggccacgccccctgtccctactcattcctttacaaaactcccgaggccgtccctcgtcggggtccctgacgcgtattccgccggctccggctcgtgggaaaccncgagtccactcacgaccngtcgacggccggacccaggtactacgtgacgtggacgtcttcgtcttacgttcgttagtcgacgggtcgtaggggaaccaacggnggtcggttggggttcggttacggggcgggtaacggggacccgtaggtccgtacggtacccggtttcgtacgggtccgacggtcccgaacggtccgtcccggtcccccgtcggttccaccgtttccg

SEQ ID NO: 376628 - DNA, 539 bp, Homo sapiens
  misc_feature: GZ8MTXP02IKBCT.11.12.B01.1.454.CMB.2.raw
  modified_base (211)..(211): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagccaccatcagctgctctggagatgtcttgactaatgagtatgcttcctggtatcagcagaggcaggccagcccctgtcctactcatctttacaaaataccaggcccgtccctcgtcggggtccctgacgcgcgttcctacccggcttcccggctcgtagggaaccacagtcactctgaccatcacgcggacccagctattgatgagctgtcttctctgtcaggcgtagggacacgacggcgtgggtcggttcgggacgggtacggacccgtggtcgtaaggtacccgttacgttacggtacgacggtacccgaacggtcccg

SEQ ID NO: 376629 - DNA, 539 bp, Homo sapiens
  misc_feature: GZ8MTXP02GEO7Y.11.12.B01.1.454.CMB.2.raw
  modified_base (195)..(195): a, c, t, g, unknown or other
  modified_base (342)..(342): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagccaccatcagctgctctggagatgtcttgactaatgagtatgcttctggtatcagcagaaggcaggccacgccccctgtcctactcatctttacaaaatccaggccggtccctcgtcggggtcccctggacgcgtacttcnccggctcccggctcgtagggaaccacgagtccactctacgaccatccgagccgggacccaggctatgatgacgctgtctacttcgtgtcgagggcgtggaacacgagtcgtggtggtcggcgggacggaccaggtcgtcgtaccgttcgtacggtcgtacgcccgaacggctccgccccgtcggtacctcgttcccg

SEQ ID NO: 376630 - DNA, 538 bp, Homo sapiens
  misc_feature: GZ8MTXP02JOVE9.11.12.B01.1.454.CMB.2.raw
  modified_base (195)..(195): a, c, t, g, unknown or other
  modified_base (222)..(222): a, c, t, g, unknown or other
  modified_base (439)..(439): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtgtcccccgganagacagccaccatcagctgctctgganatgtcttgactaatgagtatgcttctggtatcagcagaaggcaggccacgccccctgtccctactcatcttacaaaatccgaggcgccctgtcggggtccctggacgcgacttcgccggctccggctcgtagggaacacgagtcactctgaccatcacggcggacccaggtctagtgatgagctgtctacttcgtgtcgagggcgtagggacaacgngcggttggtcggtcggcgggacgggaccaggtccgacgtaccgttcgtacggtcacggcccgtaacgggcctccgcccccgttcggtaccacgttcccg

SEQ ID NO: 376631 - DNA, 586 bp, Homo sapiens
  misc_feature: GZ8MTXP02IE9IM.11.12.B01.1.454.CMB.2.raw
  modified_base (196)..(196): a, c, t, g, unknown or other
  modified_base (373)..(373): a, c, t, g, unknown or other
  modified_base (389)..(389): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgcccaccctcatcgtccgtcgtccccgganagacagccaccatcagctgctcgtggagatgtcttgactaatgagtatgtcttcgtggtatcagacagaggcacggcccacgccccctgtccctactctattctttaacaaaacgtccgaggtccgccctcggtcggggtccctggaccgtcgtacttccgtcccggtcgtcccggntccggtagggtaaacncgtacgtcctactctacgacctagaccgacggccggaccaggtctagtgagtgagtctgtcttactcgtagtcgagggcgtaggaacacgaggtcgtgggtgggtccggacgggcggtacgaggtcgtcggtaccgttacgtacgtaccgacgtaaccgacggcctcccggtccccgtacggtcctaccgttccccg

SEQ ID NO: 376632 - DNA, 550 bp, Homo sapiens
  misc_feature: GZ8MTXP02I0IAG.11.12.B01.1.454.CMB.2.raw
  modified_base (241)..(241): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagccaccatcagctgctctgganatgtcttgactaatgagtatgcttcctggtatcagcagaaggcaggccacgccccctgtccctactcatcttacaaatccaggccccgccctcgtcggggtccctgacgcgtcttcctccggcctccggctcgtgggaacacacgtcactctacgaccatcacggccggacccaggctagtgagtgagtctgtcctacttcgtacgtcgacggcgtacgggacaacgtacggcggttggtcggttcgggacgggtacggaccgtggtccgtcgtaccgtacgttacggcgtacggcccgaacggtcccg

SEQ ID NO: 376633 - DNA, 656 bp, Homo sapiens
  misc_feature: GZ8MTXP02IL5ZE.11.12.B01.1.454.CMB.2.raw
  modified_base (198)..(198): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacagccaccatcagctgctctggagatgtcttagactaatgagtatgtcttctgtatcagcagaaggcacggcccacgccccctgtccctactcattctttaacaaaactcccgaggccgcccctcgtcggggtccctggaccgcgtattccgccggtctcccggcttcggtacgggaacacgtacgtccacgtctcgacctataccgacggacccggggaacccaggtacttagttggaagttcggacgggtcttcggttccctttaacgtttccgtcggttacgacggggtacgtacggggaaacctaacggcggtcgggttaggggttcgggtcggggacggggtaacggggtaaccctggtaccgttacggtacccggtttacgttaacggtccgaacggtccccgaacggtcccgtcccggtccccccgtacggttcctacccgtttcccg

SEQ ID NO: 376634 - DNA, 589 bp, Homo sapiens
  misc_feature: GZ8MTXP02F6SPS.11.12.B01.1.454.CMB.2.raw
  modified_base (401)..(401): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagaccagccaccatcagctgctctggagatgtcttgactaatgagtatgcttcctggtatcagcagaaggcaggccacgccccctgtcctactcattcttacaaaatccaggcccgccctcgtcggggtccctgacgtcgtcttccgccggtcgtcccggtctcgtagggaaccacgacgtccactcncgaaccactcgacggtccgggacccaggcttacgttgactggacgtctcggttcttacgttcgtcgtcgagggcggtagggtacaaacgtcggtcggttgggttacgggtcggggacggggtacgggaacccgtggttccggtcggtacccggttcgttacgggtcgacggtaccccgacggtccccg

SEQ ID NO: 376635 - DNA, 524 bp, Homo sapiens
  misc_feature: GZ8MTXP02JRII9.11.12.B01.1.454.CMB.2.raw
  modified_base (337)..(337): a, c, t, g, unknown or other
  modified_base (359)..(359): a, c, t, g, unknown or other
  modified_base (389)..(389): a, c, t, g, unknown or other
  modified_base (412)..(412): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtccctactcatctttacaaaatcccaggcgccctgtcggggtccctgaccgcgattccnccggctccggctcgtgggaacncgagtcactctgaccatcagccgggacccnggctatgatgagctgtctacttntgtcagggcgtgggacagagcgtggtgtcggcggagggccgtagtcgtcggaccgtcgtacggtcacgtccgaacggtcctccggtcccccgtcggtacctaccgtttcccg

SEQ ID NO: 376636 - DNA, 560 bp, Homo sapiens
  misc_feature: GZ8MTXP02FMIJR.11.12.B01.1.454.CMB.2.raw
  modified_base (194)..(194): a, c, t, g, unknown or other
  modified_base (221)..(221): a, c, t, g, unknown or other
  modified_base (452)..(452): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggantgtcttgactaatgagtatgcttctggtatcagcagaaggcaggccacgccccctgtccctactcatctttacaaaactaccgaggccgccctcgtcggggtcccctggacgcgtacttcgtccggctcccggctcgtgggaaacacgagtccactctcgaccatccgaggccgggacccaggctagttgatgaggcttgtctacttctgtcgagggcgtagggacaacgnggtcggtggtcggtcgggcgggacgggaccgtaggtcgtacggtaccgttcgttacggcgacgaacccgaacggccgtcccggtcccccgtcggtacctaccgttccg

SEQ ID NO: 376637 - DNA, 590 bp, Homo sapiens
  misc_feature: GZ8MTXP02GHXWE.11.12.B01.1.454.CMB.2.raw
  modified_base (194)..(194): a, c, t, g, unknown or other
  modified_base (221)..(221): a, c, t, g, unknown or other
  modified_base (393)..(393): a, c, t, g, unknown or other
  modified_base (408)..(408): a, c, t, g, unknown or other
  modified_base (467)..(467): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtcttgactaatgagtatgcttctgtatcagcaagaggcaggccacgccccctgtcctactcattcttacaaaactaccgaggccgccctcggtcggggtcccctggaccgtcgtactttccgtccggcttcccggctcgtagggaacacgtacgtccactctacgaccntacgagccgggaccnggctagtgagtcgagtctagttcctacgttcgtcgtcgtacgggcgtacggaacaacgnggtccggttgggtcgggttcgggacgggtacgggaccctaggttccgtcgggtaccgttcgttaacggtccacggtaacccgacggtcccgtcccggtcccccgttcggcctaccgtttcccg

SEQ ID NO: 376638 - DNA, 645 bp, Homo sapiens
  misc_feature: GZ8MTXP02GMQYN.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccaccatcagctgctctggagtatgtcttgactaatgagtatgcttcctggtatcagcagaggcaggccacgccccctgtcctactcacttctttacaaaatacccaggccgtccctcgtcggggtccctggacgtcgacttcgccggcgtccggtctcgtacgggaacacgtacgtccactctacgaaccctatacccgacggacccgggaacccagggtcctagttgacgtggacggtcttcgtccttacttcgtagtcgaacgggcgtacgggaaccaacggtcggcggttgggtcgggttccgggggacgggtaacgggggtacctagggttcccgttacgggtacccggtttacggttacggtacccgaaccgggaaccccgtaaacgggtccccgttaccccggtccccccgttcgggtaccctcccgtttcccccgg

SEQ ID NO: 376639 - DNA, 553 bp, Homo sapiens
  misc_feature: GZ8MTXP02F4724.11.12.B01.1.454.CMB.2.raw
  modified_base (214)..(214): a, c, t, g, unknown or other
  modified_base (242)..(242): a, c, t, g, unknown or other
  modified_base (513)..(513): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatgtccgtcgtcccccgganagacagcccaccatcagctgctctgganatgtcttgactaatgagtatgcttcctggtatcagcagaggcacggccacgccccctgtcctactctattctttacaaaatccgaggccccgcccctcgtcggggtcccctggacgcgtcttccgtccgggcctccggctcgtacgggaacacagtcactctagaccatcgagccggaccagctagttgatggagtcttgtccttacttcgtcgtcgagggtcgtagggacaacgacggtcggtgggtcggttcggggcggtacgggaccnggtacgtcggaccgttcgtacggtcaccggccaggtcccg

SEQ ID NO: 376640 - DNA, 542 bp, Homo sapiens
  misc_feature: GZ8MTXP02FKJGH.11.12.B01.1.454.CMB.2.raw
  modified_base (194)..(194): a, c, t, g, unknown or other
  modified_base (350)..(350): a, c, t, g, unknown or other
  modified_base (417)..(417): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttctggtatcagcagaaggcaggccacgccccctgtccctactcatctttacaaaatcccaggccgccctgtggggtcccctgacgcgattccgtccggctcccggntcgtgggaacacagtcactctgaccatcaggcgggacccaggctagttgagtgagctgtctattcgngtcgagggtcgtcgggaacaacgaggtcgtgggtagttcggggcggaggggacccaggtccgtcgaccggtctttacgggcctacgaacccgtaaggcctccgcccccttcggccacgtttcccg

SEQ ID NO: 376641 - DNA, 550 bp, Homo sapiens
  misc_feature: GZ8MTXP02HODTM.11.12.B01.1.454.CMB.2.raw
  modified_base (194)..(194): a, c, t, g, unknown or other
  modified_base (293)..(293): a, c, t, g, unknown or other
  modified_base (331)..(331): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccacctccatgtccatcgtcccccgganagacagccaccatcagctgctctggagatgtcttgactaatgagtatgcttcctggtatcagcagaagcaggccacgccccctgtcctactcatcttanaaaactccgagcgccctcgcgggtcctgagcgacttcnccggctccgggctcgtagggaaccacagtccactctcgaccactcacggaccggacccgaggcctaagttgaatgaggtctgtcctattctgtccgaggccggtggaacaacgaggcgtgggtcggttcgggcgggacgggacctagtcgttcggaccgttaccgtttaggacgaacggacccgaaggtcccgacggtcccccccgtaggtcctacccg

SEQ ID NO: 376642 - DNA, 501 bp, Homo sapiens
  misc_feature: GZ8MTXP02FGKZQ.11.12.B01.1.454.CMB.2.raw
  modified_base (313)..(313): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctcnggggtccctgacgcgatctccggctccggctctggggaacacagtcactctgaccatcagcgggacccagcattgatgagctgtctacttctgtcagggcgtgggacaacagcgtggtgttcgggcgggagggaccagtctgaccgtcttacggtcagcccgaaggctcgccccctcggccacttccg

SEQ ID NO: 376643 - DNA, 610 bp, Homo sapiens
  misc_feature: GZ8MTXP02ICDFT.11.12.B01.1.454.CMB.2.raw
  modified_base (213)..(213): a, c, t, g, unknown or other
  modified_base (352)..(352): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccaccatcagctgctctggagatgtcttgactaatgagtatgcttcctggtatcagcagaagcaggccacgcccctgtcctactctatcttacaaaactccgaggcccgccctgtcggggtccctgacgcctnttccgtccggcctcccgctcgagggtaccactacgtcactctcgaccatacgcggaccgggacccgaggtacctagttgtaacgtggtagtcgttcgtaccttacgttcgtcgttcgtacgggtcggtacggggaacgtaacgtacgggtccgggttgggttcgggttacggggaccggggtacgggtaccggtaacgttccggtaacggtacccggttacggttacggtccgtaccggacccgtaaccggtccccgg

SEQ ID NO: 376644 - DNA, 529 bp, Homo sapiens
  misc_feature: GZ8MTXP02F3DTD.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttctggtatcagcagaaggcaggccagccccctgtccctactcatctttacaaaactccaggcggccctcgtggggtccctggacgcgtacttcgtccggctccggctcgtacgggacacgagtcactctcgaccatcgagcgggacccaggctagtgatgacgcgtgtcttcttctgtcgagggcgtagggaccaagtgcgtggtgtcgggcggacgggacctggtctcgaccgtcgttacggctacgcccgaaggcctcgtccccgtacggtcctacgttcccg

SEQ ID NO: 376645 - DNA, 716 bp, Homo sapiens
  misc_feature: GZ8MTXP02GAW46.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgcccaccctccatcgtcccgtcgtcccccggacagacacgccaccatcagctgctctggagtatgtcttgactaatgatatgtcttcctggtactcagcagaggcacggccacgcccctgtcctactctacttcctttaacaaaactaccgacggtccccggtaccccctcggtccggggtccctggacgtccgtcgtttcccgtcccggtaccgtcccgggtccttccggtacgggggaaacccaccgtacggttaccctaccgttcctacggtaaccctaacgtccggaaaccgggtccccgggggtaaacccccgagggtccgttaagtttacggagttacgggtacgggtcttcggttaccttacgtttcgtcggttacgagggtaccgggttacgggaaccaaacggtcggtcggggttggggttcgggttccgggggacggggttacggggtaaccgtcggttaccggtaacgttaccccggttacggtttaccggtaaccgccggacccggtaacggtcccccgg

SEQ ID NO: 376646 - DNA, 587 bp, Homo sapiens
  misc_feature: GZ8MTXP02JHO99.11.12.B01.1.454.CMB.2.raw
  modified_base (194)..(194): a, c, t, g, unknown or other
  modified_base (260)..(260): a, c, t, g, unknown or other
  modified_base (283)..(283): a, c, t, g, unknown or other
  modified_base (375)..(375): a, c, t, g, unknown or other
  modified_base (408)..(408): a, c, t, g, unknown or other
  modified_base (460)..(460): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccganacgacacgaccaccactcagctcgctctggagatgtcttgactatagagtatgtctctgtagtcancgagaggacgacgcgaccgcccnccgtccctactctactctactaactacaacgcgccgtccgtcgtcgtcgcgcgactcgtccgtcgccgtcgtcgcgacgacgacgcgactcncgtacagtaccaggccggaccgcggattcgtanagtgagtcgtcttcctattcctgtccgaggggtccgtagggacaagtacggngtgggggttcgtcggggcggaaccgggtacggaggttcctaaggtacccggttacggttacccgtagggaaccgccccgaaccggggtctacccggtcccccgtccgttaccccggtgtttcccccg

SEQ ID NO: 376647 - DNA, 660 bp, Homo sapiens
  misc_feature: GZ8MTXP02GMHB8.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatcgtccgtcgtcccccggacagacagccaccatcagctgctctggagatgtcttgactaatgagtatgtcttcctggtatcagcagaggcaggccacgcccctgtccctactcattctttacaaaactaccgacggccccggtccctcgtcggggtcccctaggacgtcgtactttccgtcccgggtccctcccgggcctcgtacggggaaacctacgacgtcacgtcctacgaccctactcgaacggcccgggaacccgaggtccttagttacggaagtcgggtaggtcgttcggttaccttaccgtttcgtacgttcgacgggtcggtacgggacgaaacgtcgggtccgggttgggttcgggttaccggggacggggtacggggtaacccgtcggttaccggtaacggtacccggttacggtttacgggtacccgaacggtacccccgaacgggttcccccg

SEQ ID NO: 376648 - DNA, 672 bp, Homo sapiens
  misc_feature: GZ8MTXP02F76PP.11.12.B01.1.454.CMB.2.raw
  modified_base (214)..(214): a, c, t, g, unknown or other
  modified_base (242)..(242): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagaccagccaccatcagctgctctgganatgtcttgactaatgagtatgcttcctggtatcagcagaggcaggccacgccccctgtccctactctacttccttaacaaaactccgacggccccggtccctcgtcggggtccctggacgcgtacgttccgtcccggtccgttccccggtccgttcggtacggggaaaccctaaccgtagttacccacgttacctacggaaccctaacgtccgaacgggcccggggaaccccagggtccttagttcgaagttcggagggtcttacggttaccttaccgtttcgtacgttcggaacgggtcggttacgggaacaaccggtaggtccgggttggggttacgggttccggggacggggtacggggtaccctaggttccgtaacggtacccggttacgttaacgggtccgaccggacccggtaacggtcccccg

SEQ ID NO: 376649 - DNA, 549 bp, Homo sapiens
  misc_feature: GZ8MTXP02HEV4R.11.12.B01.1.454.CMB.2.raw
  modified_base (241)..(241): a, c, t, g, unknown or other
  modified_base (346)..(346): a, c, t, g, unknown or other
  modified_base (377)..(377): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtccccccggacagacagccaccatcagctgctctgganatgtcttgactaatgagtatgtcttcctgtatcagcagaaggcaggccacgcccctgtcctactcatcttacaaatccaggccccgcctgtcggggtcctgagcnttccgccggcctccgctcgtagggaaccacngtccactctacgacccatccgacggcccgggacccaggtctattgagtggaggcttgtaccttacttcgtgtcgagggcgtagggacaaacgtggtcggtgggtcggttcggggcggtacggacctggtcgtcgaaccggttcgttaggtaccgacggacccgaacggtccc

SEQ ID NO: 376650 - DNA, 702 bp, Homo sapiens
  misc_feature: GZ8MTXP02JDFDE.11.12.B01.1.454.CMB.2.raw
  modified_base (197)..(197): a, c, t, g, unknown or other
  modified_base (250)..(250): a, c, t, g, unknown or other
  modified_base (255)..(255): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtccccccgganagacagccaccatcagctgctctggagatgtcttgactaatgagtatgcttcnggtancagcagaaggcaggccacgccccctgtccctactctattctttacaaaactcccgaggccgccctcgtcggggtccctgacgcgtacttccgccggcctccggctcggtacgggaaaccacgacgtccaaccttctacgaccctacgtcccgacgggacccggggaacccgtacgggtaccttaaggtttcggaagttcgggacggtccgttcgggttaccctttaaccgtttccgttacggtccgtaacgggggtccggtacgggggaaccgtaaacgggacgggtcgggttgggggttacggggttaccgggggccggggtaacggggacccgtacggttaccggtacgggtacccggttaccgttacgggtaccgaaccggaaccccggtaaacgggcccgttcccggtaccccccgttccgggttaccctaccgtttccccgg

SEQ ID NO: 376651 - DNA, 586 bp, Homo sapiens
  misc_feature: GZ8MTXP02JQ1EH.11.12.B01.1.454.CMB.2.raw
  modified_base (256)..(256): a, c, t, g, unknown or other
  modified_base (487)..(487): a, c, t, g, unknown or other
  modified_base (518)..(518): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccggacagacagccaccatcagctgctctggagatgtcttgactaatgagtatgtcttcctggtancagcagaaggcaggcccacgccccctgtccctactcacttctttaacaaaactacccgaggtcccggcccctcggtcggggtcccctgaccgtcgtacttcccgtcccgggcttcccgggctcggtacgggaaaccacgacgtccactctcgaccatcgacggccggacccaggtctagtgagtggacgtcttcgtcttacttcgtagtcgagggtcgtaggactaacggnggtcggtgggtcggtcgggcgggacggacgnggtcgtcggtacgttcgtacggccaccgccgacggtcccgtcccgtaccccgtcggtacctccgtccg

SEQ ID NO: 376652 - DNA, 647 bp, Homo sapiens
  misc_feature: GZ8MTXP02IR2Z2.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagctatggcatggatccctctcttcctcggcgtccttgcttactgcacagaatccatggcctcctatgagttgactcagcccaccctcatgtccgtcgtcccccgganagacagccaccatcagctgctcgtggagatgtcttgactaatgagtatgtcttcctggtatcagcagaaggcacggccacgcccctgtccctactctacttactttaacaaaactaccgacggccgtccccgtcgtcggggtccctgaccgcgtacgttccgtccggtccgtccggctccgtcgggaacacgacgtccactcgtacgaccacgtcgacgggcccgggaaccgtacggacttagttaggacgtaggacggtcgtcggttacctttacgttcgtttcggtcggtaacgggccggtaaggggaccgtaaaccggtaggccgggttagggtcgggttaccggggacgggacgggtaccgtacggttcgtacggttaccgtacgttacggtaccgacggaacccgtaacggtccgtcccggccccgtcgtcccgtaccgtttccccg

SEQ ID NO: 376653 - DNA, 689 bp, Homo sapiens
  misc_feature: GZ8MTXP02HCNXB.11.12.B01.1.454.CMB.2.raw
  modified_base (213)..(213): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccacatcagctgctctggagatgtctgactaatgagtatgcttcctggtatcagcagaaggcaggcccacgccccctgtcctactcattccttacaaactccgaggccccgccctcgtcggggtccctgagtgcttccgtccggcctccggtctcgtcgggaaccacgacgtccactcgtcgacccagtccgaacggcccgggaacccgagggtccttaaggttcgtaagtcgggtacggtccgttggttaccctttacgtttccgttcggtaccggtaacggggtccggttaacggggtaaccaaaacggtacggggtaccggggttgggggtttccgggttaccgggggaccgggggtaccggggtaaccccggtaacgggtttccgtaacccggttaccccggggtttaccggttaaacgggggtttcccgtaaccggaccccccgggtaaaggggttcccccccgg

SEQ ID NO: 376654 - DNA, 550 bp, Homo sapiens
  misc_feature: GZ8MTXP02HRAHP.11.12.B01.1.454.CMB.2.raw
  modified_base (400)..(400): a, c, t, g, unknown or other
  modified_base (447)..(447): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccacgccccctgtccctactcatctttacaaaactccaggccgccctcgtcggggtccctgacgcgtacttccgccggctcccggctccgtagggaaacacacgtcactctcgaccatcgacgccgggacccnggctattgatggagtctgttctacttctgtcgaggcgtggaacacgnggtcggtggtggtcgggacgggacgggaccctaggtctcggtaccgttcgttaacggtcacggtaacccgaacggcctccggccccctcggtcctacgtcccg

SEQ ID NO: 376655 - DNA, 556 bp, Homo sapiens
  misc_feature: GZ8MTXP02IWN24.11.12.B01.1.454.CMB.2.raw
  modified_base (213)..(213): a, c, t, g, unknown or other
  modified_base (311)..(311): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacacgccaccatcagctgctctggagatgtcttgactaatgagtatgcttctggtatcagcagagcaggccacgcccctgtcctactcatccttanaaactccgaggccccgtccctcgtcggggtccctggacgcgcttccgtccggcctccggctcgtagggaacacagtccactctcgaccatcgacggcggaccaggctagttgatgagtctgttctacttcgtcgtcgaggcgtagggacaacgtacggcggttagggtcggttacggggcgggtacgggacccgtagtcgtaacgaccggttacgttacgggacctaacggcccgaaggtccccg

SEQ ID NO: 376656 - DNA, 637 bp, Homo sapiens
  misc_feature: GZ8MTXP02JB0BV.11.12.B01.1.454.CMB.2.raw
  modified_base (627)..(627): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttctggtatcagcaagaagcaggccacgccccctgtcctactctattctttaacaaaactacccgacggccgccctcgtcggggtccctggacggcgtacttccgtccggtcctccgggctcggtacgggaaaccacgacgtcactcgtacgaacccataccgacgggacccgggaaccccgagggtacttagttacgagtggacggtcttcggttaccttacctttcgtcgttacggacggggtacgtacgggggaacctaaacggcgggtccgggttgggttcgggtcggggacggggtacgggacccgtaggtacgtacggtaccgttacgttacgggccaacggtcccgaacggtccgtcccgtcccccgtcggtacccnccggttcccg

SEQ ID NO: 376657 - DNA, 559 bp, Homo sapiens
  misc_feature: GZ8MTXP02JNVOU.11.12.B01.1.454.CMB.2.raw
  modified_base (373)..(373): a, c, t, g, unknown or other
  modified_base (391)..(391): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtgtcccccggacagaccagccaccatcagctgctctggagatgtcttgactaatgagtatgcttcctggtatcagcagaaggcaggcccacgccccctgtccctactcattctttacaaaatacccaggccgccctcgtcggggtcccctgacgcgtacttccgtccggctccggctccgtacgggaacncgacgtcactctcgaccntcgagcggacccaggctatgatgagctgtctacttctgtcgagggcgtaggacagaggtcggtgggtcggttcgggcgggtacgggaccaggtccgtcggtaccgttcgttaacgggtccacggcccgtaacgggccctccggcccccgtcggtacctaccgttcccg

SEQ ID NO: 376658 - DNA, 577 bp, Homo sapiens
  misc_feature: GZ8MTXP02JR3GV.11.12.B01.1.454.CMB.2.raw
  modified_base (456)..(456): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccaccatcagctgctctggagatgtcttgactaatgagtatgcttctggtatcagcagaggcaggccacgccccctgtccctactcatctttacaaaactcccaggccgtccctcgtcggggtcccctggaccgcgtacttccgtccgggctccggcttcgtacggggaaacctccagtccaactctacgaccctatccgacgccgggacccgagggacctatgatgacggtctgtcttacttcgtgtcgagggngtagggacacgaggtcgtggtcggtcgggcgggacgggacccaggtcgtacggaccggttcgttacggtccacggaacccgtaacggtcctccggcccccgtacggtcctaccgtttcccg

SEQ ID NO: 376659 - DNA, 560 bp, Homo sapiens
  misc_feature: GZ8MTXP02HFXK6.11.12.B01.1.454.CMB.2.raw
  modified_base (197)..(197): a, c, t, g, unknown or other
  modified_base (477)..(477): a, c, t, g, unknown or other
  modified_base (510)..(510): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctggagatgtcttgactaatgagtatgcttcctggtatcagcagaggcacggcccacgccccctgtcctactctatctttacaaaactaccaggccgccctcgtcggggtccctggacgcgtacttccgtccggctcccggctcgtacggggaaaccacgacgtccacgtcctacgacccagtccaacgggccggggaaccccagggcttaagttgatgaggctgtcttacttcgtgtcgagggtcgtcgggacaacgnggtcggtgggtgtcgggcggaagggccaggtcnggaccgtcgttacggcacgccgagcctcgccccgtcggtcctacttcccg

SEQ ID NO: 376660 - DNA, 612 bp, Homo sapiens
  misc_feature: GZ8MTXP02FUSA4.11.12.B01.1.454.CMB.2.raw
  modified_base (241)..(241): a, c, t, g, unknown or other
tcagcgagagataccacgaccggtgctcgatttagtagtgtagattccgcgggctggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacacgccaccatcagctgctctgganatgtcttgactaatgagtatgcttcctggtatcagcagaaggcacggcccacgcccccctgtccctactctattcctttaacaaaactaccgacggcccgtccctcgtcggggtccctggacgccgtattccgtccggcctcccgggcttcgtacgggaaacctacgacgtcaactcgtacgaccacgtcgacgggccgggaacccagggcttaagttggaagtggacgtcgttgttacctacgtttctcggtcgagggttccgaggggaaccaaacgtacgggtcggttacggggtcggttcggggacgggtacgggaccctaggtccgtcggtaccggttacgttacggacgaacggcccgtaaacggg

SEQ ID NO: 376661 - DNA, 667 bp, Homo sapiens
  misc_feature: GZ8MTXP02H801A.11.12.B01.1.454.CMB.2.raw
  modified_base (213)..(213): a, c, t, g, unknown or other
  modified_base (241)..(241): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgccaccctccatcgtccgtcgtccccgganagacacgccacatcagctgctcgtgganagttgtcttgaactaagtgaagtatcgtcttccgtggtatcgagacgaaggaaggccacggcccacgcccccgtgtaccctactctattacctttaaacaaaactcccgacggcccccgtccccgtacggtccggggtccctggacggtcgtacttccggtaccggcccgttcccggcttaccgggtacggaaacctccgtacgtacctacgtcgtaccgacctaacgtccgaacggtaccgggaccccgtaggtactaggttcgtaacgtcggtagtcgtacggtacctttacgtcgtcggtcgacgggtcggtacgggaaccaacggtcggtcgggttcggggtacggttccgggggacggacgggtaccgtacgtcggtaacggtaccgtcggtacggtaccacggtaccgtacgtcccccgg

SEQ ID NO: 376662 - DNA, 654 bp, Homo sapiens
  misc_feature: GZ8MTXP02HLIBY.11.12.B01.1.454.CMB.2.raw
  modified_base (195)..(195): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccaccatcagctgctctggagatgtcttgactaatgagtatgtcttctggtatcagcagaaggcacggcccacgccccctgtccctactctacttctttaacaaaactaccgacggccggtccctcggtccggggtcccctggaccgtccgtacgttccgtcccggtccgtcccggctccggtacggggaaaccacgtacgtcctacctctacgacccactaccgacggcccgggacccaggtcttagttgagtggagtcgttagttaccttacgtttcgtcgtcggtacggggtacgtacggggaacaacggtacggtcggggttgggttcggggtcggggaccggggtacgggacccgtaggtccgtacgggtacccgttcggttacggccgaccgaacccggtaacggcccgttcccggcccccgttccggtcccttacgtttcccccgg

SEQ ID NO: 376663 - DNA, 607 bp, Homo sapiens
  misc_feature: GZ8MTXP02FW2TQ.11.12.B01.1.454.CMB.2.raw
  modified_base (213)..(213): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtgtcccccgganagacagccaccatcagctgctctggagatgtcttgactaatgagtatgcttctggtatcagcagaaggcaggccacgccccctgtcctactcattactttacaaaactccgacggccccgtccctcgtcggggtccctggacgcgtcttccgccggcctcccggcttcgacggggaacctacgacgtccactctacgaccctagtccgacggaccgggacccaggcctaagttgatggacgtcttgttccttacgtcgttacggtcgacgggtcggtacgggactaaacggcggtcggttggggttcggttaccggggcggggtacggggaccctaggtaccgtaacggtacccggttcgttaacggtccgaacggtaccccgaacggtccccg

SEQ ID NO: 376664 - DNA, 549 bp, Homo sapiens
  misc_feature: GZ8MTXP02JLPPI.11.12.B01.1.454.CMB.2.raw
  modified_base (196)..(196): a, c, t, g, unknown or other
  modified_base (223)..(223): a, c, t, g, unknown or other
  modified_base (370)..(370): a, c, t, g, unknown or other
  modified_base (389)..(389): a, c, t, g, unknown or other
  modified_base (456)..(456): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccgganagacagccaccatcagctgctctgganatgtcttgactaatgagtatgcttctggtatcagcagaaggcaggcccacgccccctgtccctactctacttctttacaaaactcccgaggccgtccctgtcggggtcctgacgcgtacttcgccggctccggctcgtacgggaacnctagtccactctcgacccntccgacgccgggacccaggctagtgatgagtctagtcttacttcgtgtcgagggcgtaggacaacgnggcgtggtcgtcggcgggtacggctaggtcacggtaccgttcgtacggtccacgccgaacggccgtccgcccccgttcggtcctacgttcccg

SEQ ID NO: 376665 - DNA, 573 bp, Homo sapiens
  misc_feature: GZ8MTXP02GD044.11.12.B01.1.454.CMB.2.raw
  modified_base (194)..(194): a, c, t, g, unknown or other
  modified_base (440)..(440): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccacatcagctgctctggagatgtcttgactaatgagtatgcttctggtatcagcagaaggcaggccacgccccctgtcctactcatcttacaaaatccaggcgccctcgtcggggtccctgacgcgtattcgtccggctccggctcgtgggaacacgacgtccactctgaccatcacggccggacccaggtctagtgagtgagcttgtctacgttctgtcagggtcgtagggacaacgnggtcggtggtcggtcgggacgggtaacgggccctaaggtccgtacggtaacccgttcgtttaacggccgaaccggaaccccgtaaacgggtcccgtcccggtcccccccgttcgggtccctacctttccccgg

SEQ ID NO: 376666 - DNA, 584 bp, Homo sapiens
  misc_feature: GZ8MTXP02I9EYE.11.12.B01.1.454.CMB.2.raw
  modified_base (196)..(196): a, c, t, g, unknown or other
  modified_base (223)..(223): a, c, t, g, unknown or other
  modified_base (379)..(379): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtcccgtgtcccccgganagacagccaccatcagctgctctgganatgtcttgactaatgagtatgcttctggtatcagcagaagcaggccacgccccctgtccctactctattctttacaaaacgtaccgacggccgtcccctgtccggggtacccctgacgccgtattccgccggtctcccggctccgtaggggaaccncacgtcacgtctcgaccatcgacggaccggacccagcttagttgagtgaggctgtctacttcgtgtcgagggcgtaggacgacacggcggttggtggtaccggggcgggtacgggacctaggtccgtacggtacccggttcgttacgggtcctacggaacccgtaacgggcctcccggcccccgttcggtcccttacgtttcccg

SEQ ID NO: 376667 - DNA, 531 bp, Homo sapiens
  misc_feature: GZ8MTXP02F64IR.11.12.B01.1.454.CMB.2.raw
  modified_base (213)..(213): a, c, t, g, unknown or other
  modified_base (354)..(354): a, c, t, g, unknown or other
  modified_base (407)..(407): a, c, t, g, unknown or other
  modified_base (494)..(494): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccaccatcagctgctcgtggagatgtctgactaatgagtatgcttctggtatcagcaggaaggcacggccaccgcccctgtaccctactctattacttaacaaactccgacggccccgtccctcgtcgggtcccngacgcgtcttccgccggctcccgctcgtacgggacacagtccactcacgacancgacggccgaccagctagtgatgagctgtctacgttgtgcgaggcggtaggacacgcggtcgtggtcggtacgggcggacggtaccngtcgcgtaccgttcgtacgtcacgtacgacggtcccg

SEQ ID NO: 376668 - DNA, 655 bp, Homo sapiens
  misc_feature: GZ8MTXP02JIRX4.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccggacagacagccaccatcagctgctcgtggagatgtcttgactaatgagtatgcttctggtatcagcagaaggcaggcccacgccccctgtccctactctattacttacaaaactccgaggccgccctcggtcggggtccctggaccgtcgtacgttccgtccggtctcccggtctcggtacgggaaaccacgtacgtccaactcgtacgacccagtaccgacggccgggaaccctagggtacttagtgagtggacggtcttcggttcttacgttcgttcgtcgtacgggcggtagggaccaacggtacggtcggtagggttcgggttacggggacggggtaacgggtaccgtaggttccgtaccgggtacccggtttacgttaacggggtccctaaccgggtaacccgaacgggtcccgttccccgggtcccccgtttaccgggtccctaccgtttccccg

SEQ ID NO: 376669 - DNA, 599 bp, Homo sapiens
  misc_feature: GZ8MTXP02I81D3.11.12.B01.1.454.CMB.2.raw
  modified_base (220)..(220): a, c, t, g, unknown or other
  modified_base (239)..(239): a, c, t, g, unknown or other
  modified_base (252)..(252): a, c, t, g, unknown or other
  modified_base (367)..(367): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccacctccatgtccgtgtccccggacagacagccaccatccagctgctctgganatgtcttgactaatgagtntgtcttctggtancagcagaaggcaggccacgccccctgtccctactcacttctttacaaaactccgaggccgcccgtcgtcgggtccctgacgcacttccgccggtctccggctcggtcgggaaacncgacgcctactctacgaccatcgaacggcccggggaacccagggtcctagttcgagtcggagcttacggtaccttcttacgtgtacgaggggtaccggtgggaaaccacgtacggcggttggttcgggttccggggacgggtacgggaacccgtaggttcctagggtacccgttgttaaccggctaccgaacccgacggccgtaccggcccccgttcgccgtacctttcccg

SEQ ID NO: 376670 - DNA, 530 bp, Homo sapiens
  misc_feature: GZ8MTXP02GPCMY.11.12.B01.1.454.CMB.2.raw
  modified_base (194)..(194): a, c, t, g, unknown or other
  modified_base (221)..(221): a, c, t, g, unknown or other
  modified_base (340)..(340): a, c, t, g, unknown or other
  modified_base (390)..(390): a, c, t, g, unknown or other
  modified_base (440)..(440): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtcttgactaatgagtatgcttctggtatcagcagaagcaggccagccccctgtccctactcattcctttacaaaaatacccaggccggtccctcgtggggtccctgacgcgattcnccggctccggctcgtgggaacacagtcatctgaccatcacgcgggacccnggctattgatgaggcttagtctacttctgtcgagggcgtgggacaaacgngcggtggtgtacggggcggaggggaccagtctaggaccgttcgttaaggcacggaacccgaaggctcggcccccgtcggtccacttcccg

SEQ ID NO: 376671 - DNA, 562 bp, Homo sapiens
  misc_feature: GZ8MTXP02ICQXY.11.12.B01.1.454.CMB.2.raw
  modified_base (212)..(212): a, c, t, g, unknown or other
  modified_base (236)..(236): a, c, t, g, unknown or other
  modified_base (260)..(260): a, c, t, g, unknown or other
  modified_base (273)..(273): a, c, t, g, unknown or other
  modified_base (359)..(359): a, c, t, g, unknown or other
  modified_base (388)..(388): a, c, t, g, unknown or other
  modified_base (436)..(436): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgccaccctcatcgtccgtcgtccccgganagacacgccaccatcagctgctgngagtatgtcttagactatgaagtntcgtctcgtgtancagcagaacgcacggccaccgtccctgtcctactctatcttaacaaactccgacggcccgtcccgtcgtcggtcctgacgccgttntcccgtcgccgtaccgtcttcgagaaccncgtagctactcgacgacagtacgacgccggaccgtgtactagtgacgnggtgtctcgtaccttcgtacgttgcgtagggcggtacgaacgtaacggtgtcgggtgggttacggtcgggacgggtacgacgtgtacgtccgtaccttggtaacgcgaccggaaccgtcgtccccg

SEQ ID NO: 376672 - DNA, 605 bp, Homo sapiens
  misc_feature: GZ8MTXP02ILHWK.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtccccgganagacagccaccatcagctgctctggagatgtcttgactaatgagtatgtcttctggtatcagcagagcaggccacgcccctgtccctactcattctttacaaaactcccgaggccgccctcgtcggggtccctggaccgcgtattccgtccggcttcccggctcgtcgggaaacacagtccactctcgaccatccgacggccgggacccaggtctagttcgagtggacggtcttgttacttacctttcgttcgtacgacggggtccggtacggggaacctaaccggaggtcggttacgggttcgggttcggggacgggtacgggaccgtaggtccgtacgggtaccgttcgttacggtacgaccgaacccgaacggccgtcccggcccccgttcggtacctaccgttcccg

SEQ ID NO: 376673 - DNA, 746 bp, Homo sapiens
  misc_feature: GZ8MTXP02JN319.11.12.B01.1.454.CMB.2.raw
  modified_base (197)..(197): a, c, t, g, unknown or other
  modified_base (225)..(225): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgccaccatcagctgctctgganatgtcttgactaatgagtatgtcttcctggtatcagcagaaggcacggccacgtcccctgtccctactctacttacctttaacaaaaactcccgaaggtcccggtccccttacggtccggggtacccctaggacccgtaccgtactttcccggtccccggtccgtccccgggtcttccgggtacggggaaaaccctaccgtaacgttccctaaaccgtccgttaccggaaaccctacgtaccgaaccgggacccggggaaccccgtaacgggtaccgttaaacgttggtaacgttagggaacgggtcttacgggttccttaccgtttcccgtggtacccggtaaggggtccgggtacgggaaaccgaaacggtacgggtcgggttggggttacgggttcgggggaccggggtacggggtaacccgtacggttccggtacggtacccggttacgttaacggtccgaacgaacccggaacggtcccgtacccggtcccccgtccggtacctaccgtttccccg

SEQ ID NO: 376674 - DNA, 657 bp, Homo sapiens
  misc_feature: GZ8MTXP02IWMZO.11.12.B01.1.454.CMB.2.raw
  modified_base (213)..(213): a, c, t, g, unknown or other
  modified_base (239)..(239): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagccacatcagctgctctgganatgtcttagactaatgagtatgtcttctggtatcagcagagcaggccacgcccctgtcctactcattcttacaaaactaccgaggccccgtccctcgtcggggtccctgacgcgtacgttccgtccggccttccggccttcgtacggggaacccacacgtccacctctacgaccatccgacggcccgggaacccagggtccttaagttggtatggtacggtcttcggttaccttaacgtttccgtggtacgtaacgggtcgggttaacggggaaccaaaaccgtgggtaccgggttaggggttcggggttaccggggaccggggaaccggggtaacccgtacggttccggtaacggttaccccgggttacgttaacgggggttaccaacccgggttaccccgaaacgggttcccccgg

SEQ ID NO: 376675 - DNA, 583 bp, Homo sapiens
  misc_feature: GZ8MTXP02JES2B.11.12.B01.1.454.CMB.2.raw
  modified_base (242)..(242): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacacgccaccatcagctgctctgganatgtcttgactaatgagtatgtcttctggtatcagcagagcacggcccacgcccctgtccctactctattcttaacaaactaccgacggccccgtccctcgtcgggtccctgacgcgcgttcgccggtccgtccgctacgtacgggaaccacgtacgtccactcgtacgacccatccgacggccggaccaggcttatcgagtggagtcttcgtctacgttctcggtcgacggtcggtacggacaacgcggtcggttgggtcggttccggggacgggacgggaccgtacggtccgtaacggtaccgttacgttacgggaccaccggtacccgacggtccccg

SEQ ID NO: 376676 - DNA, 645 bp, Homo sapiens
  misc_feature: GZ8MTXP02I6FMN.11.12.B01.1.454.CMB.2.raw
  modified_base (211)..(211): a, c, t, g, unknown or other
  modified_base (240)..(240): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgccaccctcatcgtccgtcgtccccganagacacgccacatcagctgctgtggagtntgtctgactaatgagtatgtcttccgtaggtactcgagcaggacggtcgacggcccacgtcccctgtaccctactctacttacttaaacaaacgtccgacggccccgtcccctggtcggggtccctaggacgtcgtcgttccgtcccgggtactcccgggctacgtacgggaaactacgtacgtccaccgttacgacgaaccctacgtacccggaagggtaccccgggaaccgtaacgggtccttaaggttcggtagtacgggtcggtcttcggtttacccttacgttcgtacggtcgaacgggtcggtaacgggaactacggtacggtgggttgggtacggtacgggacgggtacgaccgtgttccgtaacgtcgttacgttacgcgacgtccgtacggtcccg

SEQ ID NO: 376677 - DNA, 614 bp, Homo sapiens
  misc_feature: GZ8MTXP02IZTDU.11.12.B01.1.454.CMB.2.raw
  modified_base (214)..(214): a, c, t, g, unknown or other
  modified_base (241)..(241): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccaccatcagctgctctgganatgtcttgactaatgagtatgcttccgtggtatcagcagaggcaggccacgccccctgtccctactcatcttacaaatccgagccccgtcctcgtcgggtccctgacgtcgtcttccgtccggtccgtcccgggtcttccggtacgggaacctaccgtacgtcccaaccgtcgtacgaaccctactaccggacggtacccgggaacccagggtcctagtttacgagtcggtacggtcttcgtaccttaccttcgtacggtcgacggggtcggttacgggaacaaaccggtggtccggtagggtacggttcggggacggtacggaccgtagtccgtcgtacgttcgtacggtacgaccgaccgtacggtccccg

SEQ ID NO: 376678 - DNA, 584 bp, Homo sapiens
  misc_feature: GZ8MTXP02HWQZ3.11.12.B01.1.454.CMB.2.raw
  modified_base (196)..(196): a, c, t, g, unknown or other
  modified_base (481)..(481): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacacgccaccatcagctgctcgtggagattgtcttgactaatgagtatgtcttcgtggtatcgagacagaaggcacggccaccgccccctgtccctactcacttctttaacaaaactccgacggccgtcccctcggtccggggtcctgaccgtcgtacgtttcccgccggtcgttcccggctcggtacgggaactacgacgtaccaccgtctaccgaaccacgtcgacggacccggacccgacgtcttagttgagtggacgtctagttcttacttcgtgtcgnggcggtacgacgagagcggttggtcggtcgggacggcggacgtaggtcgtcgtacgtcgtacgtacgacgcgacgtccgtccgcccgtccgtctacgttcccg

SEQ ID NO: 376679 - DNA, 548 bp, Homo sapiens
  misc_feature: GZ8MTXP02FRSCL.11.12.B01.1.454.CMB.2.raw
  modified_base (355)..(355): a, c, t, g, unknown or other
  modified_base (455)..(455): a, c, t, g, unknown or other
  modified_base (476)..(476): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagccaccatcagctgctctggagatgtcttgactaatgagtatgcttcctggtatcagcagaggcaggccacgcccctgtccctactcattcttacaaaatccgaggccccgccctcgtggggtcccctagacgcgtnttcctcccggctcccggctcgtaggggaaaccacagtccactctcgaccatccgagccgggacccaggtctagttgatggaggtctacgttctacgttcngtcagggcgtaggacaacggnggtcgtgggtcggtcgggcggacggacctagtccgtcgtaccgttacgtacggacgacggaccgacggtccg

SEQ ID NO: 376680 - DNA, 619 bp, Homo sapiens
  misc_feature: GZ8MTXP02G8VTH.11.12.B01.1.454.CMB.2.raw
  modified_base (214)..(214): a, c, t, g, unknown or other
  modified_base (220)..(220): a, c, t, g, unknown or other
  modified_base (243)..(243): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganacgacncgccaccatcagctgctctgganatgtctgactaatgagtatgtcttctggtatcagcagaaggcaggccacgcccctgtcctactcattcttacaaatccgagcccggccctcgtcggggtcctgacgcgtcttccgtccgggcctcccggcgttcgtacgggaaacccacgagtccacgtcctacgacccatccgacggacccggggacccagggcttacgtagacgtcggacggtcttcggtccttaaccgttcgtcggttccgaaggggtcccggttaggggaaccaaacggtcggcgggttgggtcgggttcggggacgggacggggtacctacgggttccgtaacggtaccggttcggttaacggtccgaaccggtacccggaacggtccccg

SEQ ID NO: 376681 - DNA, 634 bp, Homo sapiens
  misc_feature: GZ8MTXP02F9MFM.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacacgccaccatcagctgctctggagatgtcttgactaatgagtatgtcttcctggtatcgagacaaggaaggcgacggcccaccgccccctgtcccctactctacttcttacaaaactaccgaggcccccggtccccgtcgtcggggtccctggacgccgtgttccgcccgggtcctcccgggtccttcgtacggggaaacaccgtagtaccctactcgtacgaccctacgtccgacggacccgggaccacggtcttagtttggagtaggtacggtcgttacggttccttacgttcgtgtcggacgggtcgtacggggaacaacgacggtcggttgggtcgggttcggggacgggtacggggaccgtagtccgtcggtaccgttacgttacggtccgaccggacccgtacggtccccg

SEQ ID NO: 376682 - DNA, 583 bp, Homo sapiens
  misc_feature: GZ8MTXP02FM02I.11.12.B01.1.454.CMB.2.raw
  modified_base (194)..(194): a, c, t, g, unknown or other
  modified_base (475)..(475): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccacgccccctgtcctactcatactttacaaaatccaggccgtccctcgtggggtccctggacgcgtatccgcggctccggctcgtagggaaccagacgtacactctacgaccctagtaccgacggccgggacccgaggtactagtttgagtgaggtcttggtcttaaccgttcgtcgttcgacgggtcgtagggggaacaaaccggnggtcggttgggtcggtcggggacgggacggaccgtacggtcgtacggtacgttcgttacggccgacggaaccgtacggtccgtcccggtccccgtacgtcctacgtcc

SEQ ID NO: 376683 - DNA, 723 bp, Homo sapiens
  misc_feature: GZ8MTXP02IGZ35.11.12.B01.1.454.CMB.2.raw
  modified_base (197)..(197): a, c, t, g, unknown or other
  modified_base (298)..(298): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgccaccctccatcgtccgtcgtcccccgganagacagcccacatcagctgctcgtggagtatgtcttgactaagtgagtatcgtcttccgtggtactcagcaaggaagcacggccacgtcccctgtcctacnctatacctttaacaaaactaccgacgggccgtccctcggtcggggtccctggaccgtcgtacgttcccgccggtccgtccggtcgtcggtacgggaaacacgtacgtacctactcctacgacctacgtaccggacgggacccgggaacccgtaacggggtctttaacggtaggtaggtacgggtacgggttcgttacggtttacccttaccggtttcggttacggtccgggtaacgggggtccggggttaacggggaaaccgtaaacggtcggggttcggggttacggggtttccgggggtacgggggaccggggtacggggaccgttaggtccgtacggtacccggttacggtcgtaaccggaccggtaacccgtaacggtcccgttacccggtcccccgtccggtaccctaccgtttccccgg

SEQ ID NO: 376684 - DNA, 535 bp, Homo sapiens
  misc_feature: GZ8MTXP02FV2LD.11.12.B01.1.454.CMB.2.raw
  modified_base (194)..(194): a, c, t, g, unknown or other
  modified_base (221)..(221): a, c, t, g, unknown or other
  modified_base (375)..(375): a, c, t, g, unknown or other
  modified_base (443)..(443): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctgganatgtctgactaatgagtatgcttctggtatcagcagaaggcaggccacgccccctgtccctactcatctttacaaaatcccgaggccgccctcgtcggggtccctgacgcgacttcgccggctcccggctcgtacgggaacacgacgtcactcncgaccatcgacgccggacccaggctattgatgagctgtctacttctgtcgagggcgtagggacaacgnggtcgtggtgtcgggcgggacgggacagtcgtacggaccgttcgttacggcacgaacccgaaggcctccggccccgtcggcctaccgttccg

SEQ ID NO: 376685 - DNA, 677 bp, Homo sapiens
  misc_feature: GZ8MTXP02G2NSB.11.12.B01.1.454.CMB.2.raw
  modified_base (227)..(227): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccggacagacacgccaccatcagctgctcgtgganatgtcttgactaatgatatgcttcgtggtatcagcagaagcgacgccacgcccctgtccctactctacttcttaacaaaactcccgacggtccggtccccgtgtcggggtccctgaccgtcgtacgttccgtccggtccgtccggtctccgtacgggaacacgtacgtaccacctcgtaccgaaccctgtacccgacggggcccgggaacctagggtaccttagtcgagtacgggacggttcttacggttcctttaaccgtttcggtaggttaccgacgggggtacgaaccggggtaaccaacgggtcgggtacgggttgggttacggggttaccgggacggggtaacgggtaccgtacggtccgttacggaccggtttcgtaacggcccgtaacggcccgtacggccccgttccggcccccgttaccggtaccttacccgtttccccgg

SEQ ID NO: 376686 - DNA, 593 bp, Homo sapiens
  misc_feature: GZ8MTXP02GHT92.11.12.B01.1.454.CMB.2.raw
  modified_base (198)..(198): a, c, t, g, unknown or other
  modified_base (225)..(225): a, c, t, g, unknown or other
  modified_base (489)..(489): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtcccgtcgtccccccgganagacagccaccatcagctgctctggantgtcttgactaatgagtatgtcttctggtatcagcagaaggcacggccacgcccctgtccctactctattaccttaacaaaactcccgacggccgtccctcgtcggggtccctgaccgctacgttccgtccggctaccggctcgtacgggaacacgtacgtccacgtctacgaccagtaccgacggcccgggacctaggtctagttagagtcggacgtcttacgtcttacgttcgtgtcggtagggtcggtacggaacaacggnggtcgggttggtcgggtcgggcggacgggactaggtcgtacggtaccgttacgttacggcaacggcccgtacggcctcccggccccgtacgtcctcctttcccg

SEQ ID NO: 376687 - DNA, 605 bp, Homo sapiens
  misc_feature: GZ8MTXP02HHJCZ.11.12.B01.1.454.CMB.2.raw
  modified_base (213)..(213): a, c, t, g, unknown or other
  modified_base (240)..(240): a, c, t, g, unknown or other
  modified_base (254)..(254): a, c, t, g, unknown or other
  modified_base (271)..(271): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtccccgganagacagccaccatcagctgctctgganatgtcttgactaangatatgtcttctggtancagcagaaggcaggccacgccccctgtcctactctatcttaacaaaactcgacggccccgtaccctcgtcggggtcctaggacgcgtacttccgccggtcctcccgggtctcgtagggaaaccacacgtaccactctacggaacccagtaccgaacggcccgggaaccccgagggtaccttaaagtttgaagtcggtaggcttggtacttacttcgtcgtacgacgggtcgtacggggaacaacgtggcggtgggtacggttcggggacgggacgggaccgtacgtccggtaacgtaccgttacgttacgggaccacggacccgaacggtcccg

SEQ ID NO: 376688 - DNA, 613 bp, Homo sapiens
  misc_feature: GZ8MTXP02ISVWI.11.12.B01.1.454.CMB.2.raw
  modified_base (216)..(216): a, c, t, g, unknown or other
  modified_base (243)..(243): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggactccccctcttcctcggcgtccttgcttactgcacagaatccatggcctcctatgagttgactcagcccaccctccatcgtccgtcgtcccccgganagacagccaccatcagctgctctgganatgtcttgactaatgagtatgtcttctagtatatcagcaaggaaggcgacggccaccgcccctgtccctactctacttacttaacaaaactaccgacggtccccgcccgtcgtcggggtcctggacgtcgtcgttccgtccggcctcccggcctcgtacgggaaaccacgtacgtaccactctacgacctacgtcgacggaccgggaccaggacttagtcgagtggagtctcgttacttacgttcgtacgtcgtacgggtcgtacggaacgtaacgcggtcgggttgggttcggttcggggacgggtacgggaccgtacgtcgtaaccggtaccgttacggttacggacgaccgaccgtaacggtccccg

SEQ ID NO: 376689 - DNA, 572 bp, Homo sapiens
  misc_feature: GZ8MTXP02JB712.11.12.B01.1.454.CMB.2.raw
  modified_base (215)..(215): a, c, t, g, unknown or other
  modified_base (455)..(455): a, c, t, g, unknown or other
  modified_base (471)..(471): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcagccaccctccatcgtcccgtcgtccccccgganacgacacgccaccatcagctgctctggagatgtcttgactaatgagtatgcttctggtatcagcagaggcaggccacgtccccctgtccctactcaacttccttaacaaatccgaggccccgccctcgtcggggtccctggacgcgtacttccgcccgggcctcccgggctcggtacggggaaaccacgacgtccacctctcgaacccatccgacggccggacccaggctagttgatggngtctgtactacgttcngtcgaggtccgtaggactacggcggtcggtggtcggtacgggacgggacggacctaggtcgtaacggtaccgttacgttacggacgacgacccgacggtcc

SEQ ID NO: 376690 - DNA, 645 bp, Homo sapiens
  misc_feature: GZ8MTXP02JCWM6.11.12.B01.1.454.CMB.2.raw
  modified_base (214)..(214): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacacgccaccatcagctgctcgtggagatgtcttgaactaatgtaagtatcgtcttccgtggtatcagcgaagacggcacggccaccgtccccctgtaccctactctacttccttaacaaaactccgacggtcccccgtcccctcggtcggggtccctggacgtccgtcgttccgcccggtccgtcccggtctcggtacgggaaccacgtacgtccacttcgtacgaacccagtccgaacgggcccgggaacccagggtccttaagttcggagtcggtacggtcttcggttacccttacgtttcgtcggtaccgtacgggtcggtacgggaacaacggtcggtcggttgggttcgggtcgggacgggtacgggaccgtaggtccgtaacggtaccgttacgttacggtccaccggtaccgacgtccccg

SEQ ID NO: 376691 - DNA, 612 bp, Homo sapiens
  misc_feature: GZ8MTXP02H66R9.11.12.B01.1.454.CMB.2.raw
  modified_base (192)..(192): a, c, t, g, unknown or other
  modified_base (220)..(220): a, c, t, g, unknown or other
  modified_base (286)..(286): a, c, t, g, unknown or other
  modified_base (383)..(383): a, c, t, g, unknown or other
  modified_base (393)..(393): a, c, t, g, unknown or other
  modified_base (406)..(406): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagccacctccatgtccgtgtcccccgganagacacgccacatcagctgctctggagntgtcttgactaatgtagtatgtcttcgtggtatcagcagaggcaggcccagccccctgtccctacnctatctttaacaaaactccgaggccgcctcgtcggggtaccctgaccgcgtacgtttccgccggtctccgggctcgtagggaacacgtcgctacgtntacgacctancgacgccggaccnggtctagtgagtgagtcagttccttacttcgtacggtcgacgggtacgtacggaacgaacgtcgggtcggttcggggtcgttcgggggaacggtacggacccgttggtaccgtacggtacccgttacggtttacggacctaaccgggtaaccccgtaacggcccgttacccggtccccccggttaggtccccttaacgtttccccg

SEQ ID NO: 376692 - DNA, 692 bp, Homo sapiens
  misc_feature: GZ8MTXP02JUWTL.11.12.B01.1.454.CMB.2.raw
  modified_base (196)..(196): a, c, t, g, unknown or other
  modified_base (223)..(223): a, c, t, g, unknown or other
  modified_base (406)..(406): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctcatcgtccgtcgtcccccgganagacagccaccatcagctgctctgganatgtcttgactaatgagtatcgtcttcgtggtatcgagacgaaggaacggcgacggcccacgcccccctgtaccctactctattactttaacaaaactcccgacggtcccgtccctcgtccggggtccctaggacccggtcgtacttcccgtcccgggtctccgggtctcggtacgggaaccncgtacgtctacctctacgacctacgtaccggaccgggacccggaccgaggtactagtgtacgtggtacgtcttacgttcgtttactcgttacgcggtacgggtcggtaacggaaccgaggtacgggttcggttcgggggttacgggtcgggggaacgggtaccggtaaccggtcggttaccggtaccggttaccggtttacggtacgggtaacccgacccgggtaaccgtaccgggttccccgtacccccggtaccccggtccggttaaccctccgtttaccccgg

SEQ ID NO: 376693 - DNA, 597 bp, Homo sapiens
  misc_feature: GZ8MTXP02HZVQJ.11.12.B01.1.454.CMB.2.raw
  modified_base (196)..(196): a, c, t, g, unknown or other
  modified_base (223)..(223): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtccccccgganagacagccaccatcagctgctctgganattgtcttgactaatgagtatgcttctggtatcagcagaaggcacggcccacgccccctgtccctactctatctttacaaaatccgaggccgccctcgtcggggtcctggcgcgtattccgtccggctccggctcggtagggaaccacgacgtccactctacgaccataccgacggccgggacccaggtctagttgacgtggacgtcttacgtcttacgttcgtcgtcgagggtcgtagggacaacgaggtcggttgggttcggtacgggcgggtacgggaccgtaggtccgtacggtaccggttacgttacgggtacctacggaacccgaacggtcccgtcccggtcccccgtcggtaccctaccgtttcccg

SEQ ID NO: 376694 - DNA, 704 bp, Homo sapiens
  misc_feature: GZ8MTXP02IQPOT.11.12.B01.1.454.CMB.2.raw
  modified_base (198)..(198): a, c, t, g, unknown or other
  modified_base (226)..(226): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacagccaccatcagctgctctggagntgtcttgactaatgatatgtcttctggtatcagcagagcaggcccacgcccctgtccctactctacttactttaacaaaactacccgacgggtccggtccccttacggtcgggggtcccctggacgtccgtactttccgtccgggtccttcccggggctcgggtacgggaaaccaccgtacgtcccaactcgtacgaccctagtaccgacgggacccggggaccctaagggtacctttaggttagtaacggtgggacggtcgttacggttacctttaaccgtttcgttggttacccggagggggtacccgggttacggggaaaccaacggtacgggtcgggttggggttacgggttccgggggacgggggtaacgggtaccgtaggtcgttacggtaaccggtttcggttaacggtccgaacggtcccgaacgggtcccgttcccggtcccccgttacggtaccctaccgtttccccg

SEQ ID NO: 376695 - DNA, 723 bp, Homo sapiens
  misc_feature: GZ8MTXP02JOKM3.11.12.B01.1.454.CMB.2.raw
  modified_base (222)..(222): a, c, t, g, unknown or other
  modified_base (288)..(288): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagccaccatcagctgctctgganatgtcttgactaatgagtatgcttcctggtatcagcagaaggcaggcccagccccctgtccctacncatctttacaaaatcccaggcggcccctcgtcggggcccctgacgtccgattcgcccggctcccggctccgtacggggaacacgtacgtccacgtctcgacccactaccgaggccggggacccagggtcttagttcggaagttggacgggtcttggttcccttacgtttccgttacggtaccgtggggtaccggttacggggaaccgaaaaccggtacgggtccgggttggggttacgggggtttccgggggacccgggggttaacgggggacccccggtaaggggttcccggttacggggtaaccccggtttaccgggtttacccggggttaacccggaaccgggttaacccccgggaaaacggggttcccccggtaccccggtccccccccggtttaacccgggggttcccccgtaaccccgttttcccccgg

SEQ ID NO: 376696 - DNA, 691 bp, Homo sapiens
  misc_feature: GZ8MTXP02HZGKK.11.12.B01.1.454.CMB.2.raw
  modified_base (197)..(197): a, c, t, g, unknown or other
  modified_base (210)..(210): a, c, t, g, unknown or other
  modified_base (259)..(259): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgcccaccctcatcgtccgtcgtcccccgganagacagccaccancagctgctcgtggagtatgtcttgaactaagtgtagtatcgtcttccgnggtatcagacagaaggcacggcccacgccccctgtccctactcattctttaacaaaactccgacggccgcccgtcggtcggggtccctggaccgtcgtacgttccgccgggtacttccccgggctccggtacgggaaacctacgtcgttccaacgtccacgaccacgaccgacggccgggacccgagtacttagtgtaagtgtacggtctggttccttaccgttcgttcgtacggacgggtcggtacggaaccgtaacggtacgggtcgggttcgggttacgggttacggggaccgggggtaacgggtaacccgtacgggtccggttaccggttaacccggttaccggtttacgggaccgtaccgggtaaccccggtaacgggcccgtttcccgggaccccccgtttcgggtcccctttacccgttcccccg

SEQ ID NO: 376697 - DNA, 630 bp, Homo sapiens
  misc_feature: GZ8MTXP02JGKDR.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgcccaccctccatcgtcccgtcgtcccccggacagacagccaccatcagctgctcgtggagattgtcttgaactaatgagtatcgtccttcctggtatcagacgagaaggcaggccacgcccgccttcgtcctactctacttactttaacaaaactaccgacgggcccgtccccgtcgtcggggtccctggacgcgtactccgtcccgcgtcccggctcgacgggaaccacacgtcactcgacgaccatcgacggccggacccgagtcctagttcgagtcgacggtcttcgttccttaccgttgtacgttccggaagggttccgggaacggaacctaagcggggtacggttcggggttcggttacggggacggggacggtacgtacggtcgtaccggtaccgttacgttacggaccgaacgaccccggacggtcccgtacccgtcccccgtacggtcctacccg

SEQ ID NO: 376698 - DNA, 668 bp, Homo sapiens
  misc_feature: GZ8MTXP02HQS3D.11.12.B01.1.454.CMB.2.raw
  modified_base (197)..(197): a, c, t, g, unknown or other
  modified_base (379)..(379): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccacatcagctgctcgtggagatgtcttagactaatgagtatcgtcttcgtggtatcagcaagaaggcaggcccacgccccctgtccctactctaacttcttaacaaaactcccgacggccgtccctcgtccggggtcctggacgtccgtacttcccgcccggtctcccccgggtnttccggtacgggaaacctacgtaccgtacctacgtcgtaccgactacgacggaccgggaccggacgtagtacgttagtgacgtcggacgtcttcgttacttcgttcgtacggacggtacgggtacggaacggaacgtacggtcgggttcgggtcgggttacggggtacggggaacggggtacgtacggtacggttaccgtacggttaccgttacggtacggtacccgaccggtaaccggaccggtcccgttcccccggtacccgttaccgttaccgttacccgttcccg

SEQ ID NO: 376699 - DNA, 629 bp, Homo sapiens
  misc_feature: GZ8MTXP02GV0G3.11.12.B01.1.454.CMB.2.raw
  modified_base (197)..(197): a, c, t, g, unknown or other
  modified_base (226)..(226): a, c, t, g, unknown or other
  modified_base (243)..(243): a, c, t, g, unknown or other
  modified_base (250)..(250): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtcccgtcgtcccccgganagacacgccaccatcagctgctctggagntgtcttgactatgagtntgcttcngtatcagcagagcagccacgccccctgtccctactcacttacttaacaaaactcccgaggccggtcccctcggtccggggtcctggaccgtcgtactttccgcccgggtcctcccgggtctcgggtacgggaaacctacggtacgtaccctacttccacggaacccacgtaccggacgggacccggggaacccagggtaccttaagttgacgttggacggtcttcgttcttacgttcgtcgtcgagggtcggtagggacaagtcggtcggttgggtcggtcggggacgggtaacgggccgtaggtccgtacggtaccgttcgtacggtaccgacggaacccgaacggtcctccggcccccgtcggtcctacgtttcccg

SEQ ID NO: 376700 - DNA, 611 bp, Homo sapiens
  misc_feature: GZ8MTXP02IX1G0.11.12.B01.1.454.CMB.2.raw
  modified_base (194)..(194): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaagcaggccacgcccctgtcctactcatctttacaaaactaccgaggccgtccctcgtcggggtccctgacgcgtacttcgccgctccggctcgtacggggaaccacgtacgtcactctacgaccagtcacggccggacccaggacttagtcgagtgaggtcttacggtcttacgttcgtcgtaccgtaggggccggttacggggaacctaacggacgggtccggttggggtacgttacgggggcgggtaacgggacccgtaggtccgttacggtacccgttcgtttacggacgaaccggaaccccgaacgggtcccgtcccggccccccgttcggtcccgactttccccgg

SEQ ID NO: 376701 - DNA, 746 bp, Homo sapiens
  misc_feature: GZ8MTXP02JA0F9.11.12.B01.1.454.CMB.2.raw
  modified_base (195)..(195): a, c, t, g, unknown or other
  modified_base (223)..(223): a, c, t, g, unknown or other
  modified_base (248)..(248): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccaccatcagctgctctggagntgtcttgactaatgagtatgcttcnggtatcagcagacgcaggcccacgccccctgtccctactctacttcctttaacaaaactcccgacggacccggtcccccgttcggttccggggtccccttaggaccggtcgtaccgtttccgtcccgggtccttccccgggctccgtaggggaaacccacgtacgttccactccgttcgaaacccagtacccgaacggggcccggggtaccccgtaagggtaccttacgttagtaacggttgggacggtcctttacggtacctttaccgtttcgttcggttaccgacgggggtaccggtacggggtaacccgtaaaggtacggttccggggttagggttccgggggttacgggggaacccggggtaccgggggtacctaaagggtttcccccggtaaggttacccggtttacggtacgggtacccgaccgggaaccccgtaaacggggtcccgtacccggttccccccgttcggttaccccgtcccttttacccccgg

SEQ ID NO: 376702 - DNA, 564 bp, Homo sapiens
  misc_feature: GZ8MTXP02H80L0.11.12.B01.1.454.CMB.2.raw
  modified_base (449)..(449): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttctggtatcagcagaaggcaggccagccccctgtccctactcattcctttacaaaactccaggccgccctcgtcggggtccctgacgcgattccgccggctccggctcgtagggaacacagtccactctgacccatcgacgccgggacccagtctagtgatggacgtctgtcttacttcgtgtcgagggcgtagggaacaaacgnggtacggtggtaggtccgggacgggacgggacctaggtccttacggacccgttcgtttacggccgaaccggaacccgaaggcctcccggacccccgtcggtcctaacgttccccg

SEQ ID NO: 376703 - DNA, 564 bp, Homo sapiens
  misc_feature: GZ8MTXP02F92WO.11.12.B01.1.454.CMB.2.raw
  modified_base (212)..(212): a, c, t, g, unknown or other
  modified_base (349)..(349): a, c, t, g, unknown or other
  modified_base (353)..(353): a, c, t, g, unknown or other
  modified_base (392)..(392): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatcaatggcctcctatgagttgactcagccaccctccatgtccgtgtcccccgganagacagccaccatcagctgctctggagatgtcttgactaatgagtatgcttcctggtatcagcagaagcaggccacgccccctgtcctactcatcttacaaaataccaggcccgccctcgtggggtccctgacgcgnttcnccggctcccggctcgacgacacgtcacactcgacactanacgacggcccgtaaccgagtattagtgaagtggcggtcttacgtacttaccgttcgtcggtcgagggtcgggtaacggaaaccaaggtacggtcgggtggttcgggtcggggacgggacggaacctggtacgtaacgtcccgttagtacgtccgaccgaccgaacggtcccg

SEQ ID NO: 376704 - DNA, 588 bp, Homo sapiens
  misc_feature: GZ8MTXP02GA5ZC.11.12.B01.1.454.CMB.2.raw
  modified_base (197)..(197): a, c, t, g, unknown or other
  modified_base (224)..(224): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtcccgtgtccccccgganagacagccaccatcagctgctctgganatgtcttgactaatgagtatgcttcctggtatcagcagaaggcaggcccacgccccctgtccctactcacttctttacaaaactcccgaggccgaccctcgtcggggtcccctggaccgtcgtacttccgtcccggctcccgggctccgtacgggaaaccacgtacgtccacgtctacgaccatccgaggcccgggacccagggtctagttgaactggacgtctagttcctacttctgtcgagggtcgtagggacaacgaggtcgtgggtcgggtcgggcgggtaacgggcctaggtcgtacggtaccgttcgttaacggccacggcccgaggccgtccgcccccgtcggtacctacgttcccg

SEQ ID NO: 376705 - DNA, 599 bp, Homo sapiens
  misc_feature: GZ8MTXP02HX8YC.11.12.B01.1.454.CMB.2.raw
  modified_base (198)..(198): a, c, t, g, unknown or other
  modified_base (379)..(379): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacagccaccatcagctgctctggagatgtcttagactaatgagtatgtcttcctggtatcagcaagaaggcaggccacgccccctgtccctactctattctttaacaaaatcccgaggtccgcccctcgtcggggtccctggacgcgtacttccgtccggctccggctcgtcgggaacncagtcactctcgaccatcgacggccggacccaggtctagttgagtggacgtcgttcgtcttacgttcgttgtccgagggtccggtaggaacctaaacgtgggttggttgggtacggttcggggacgggtacgggacccgtaggttccgtcggtacccggttcgttacggtcacggtcccgaacggtcccgtcccgtcccccgtcggtcctaccgttcccg

SEQ ID NO: 376706 - DNA, 605 bp, Homo sapiens
  misc_feature: GZ8MTXP02IO5PP.11.12.B01.1.454.CMB.2.raw
  modified_base (239)..(239): a, c, t, g, unknown or other
  modified_base (275)..(275): a, c, t, g, unknown or other
  modified_base (349)..(349): a, c, t, g, unknown or other
  modified_base (355)..(355): a, c, t, g, unknown or other
  modified_base (399)..(399): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatgtccgtcgtcccccggacagacagcccacatcagctgctctgganatgtcttgactatgagtatgtcttcctggtatcgancgaagaggcaggcccacgccccctgtccctactcacttcttaacaaaatccaggccccgtccctgtcgggtccngcgctnttccgccggctccgctcgaggacacgagtcactcgtcgacctanccgacggtccgggacccagggtccttagtgaacgtgggacgtcgttcgttcctacgtttcgtcgttcggagggccggttagggaaccaaaacgtcggggtcggttggggttcgggttcgggggaccgggtacggggtaccgtacggtttccgtaaccgggtaccgttccggtttacggcccgtaacggcccgaaccggttccccgg

SEQ ID NO: 376707 - DNA, 717 bp, Homo sapiens
  misc_feature: GZ8MTXP02I0U58.11.12.B01.1.454.CMB.2.raw
  modified_base (226)..(226): a, c, t, g, unknown or other
  modified_base (447)..(447): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccggacagacacgccaccatcagctgctcgtgganatgtcttgactaatgagtatgtcttctggtatcagcaaggaaggcacggcccacgccccctgtccctactctactttacctttaacaaaacttacccgacggtcccgccccttcgtccggggtcccctggaccgcgtacttccgtcccggtcgtcccggtctcggtacgggaacctacgtacgtccacgtctaccgaccactccgacggccgggaacccgngtacttagttgagtcgggacggtcttacggttacctttacgttcgttacggtacggtacgggggtaccggttacggggaaccgtaaacggtacggggtcggggtttcggggtttacgggggttcccgggggacgggggtaaccggggtacccggttacgggttccgttaaccgggtacccggtttacggttaaccgggttaccgaacccggtaacccggaacggtcccgtaccccggtcccccgttaccgggtccctacccgtttccccg

SEQ ID NO: 376708 - DNA, 590 bp, Homo sapiens
  misc_feature: GZ8MTXP02G86D1.11.12.B01.1.454.CMB.2.raw
  modified_base (195)..(195): a, c, t, g, unknown or other
  modified_base (254)..(254): a, c, t, g, unknown or other
  modified_base (372)..(372): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctcatcgtccgtcgtcccccgganagacagccaccatcagctgctctggagatgtcttgactaatgagtatgcttcctggtancagcagaggcaggccacgccccctgtacctactcattccttaacaaaagtcccgaggccgccctgtcggggccctgacgtcgtcttcgccggctccgctcgtaggacacagtcactcncgacctataccgacggaccgggacccaggtaccttagtacggagtggacgtccgttgttaacctcctttcggacgttcggacgggtacgtcgggaaaccgtaacgcggtccggttgggtcgggttaccggggcggggaacggacgtcggtccgtggacccgttgttacgccgtacggcccgacggtccctaccgtcccgtcggtcctaccgtttcccg

SEQ ID NO: 376709 - DNA, 607 bp, Homo sapiens
  misc_feature: GZ8MTXP02G8W4F.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacacgccaccatcagctgctctggagatgtcttgactaatgagtatgcttcctggtatcagcagaggcacggccacgcccctgtcctactctatactttaacaaaatccgaggccccgtccctcgtcggggtccctggacgcgtcttccgtcccggcctcccggctcgacgggaacacgacgtccactctcgaccacgtccgacggccgggaacccgacgggcttagttgagtcggacggtcttcggttcctaccgtttcgtacgttcgacgggtcggtacgggtaacaacggtacggtcgggttgggtcgggttcgggacggggacggggaccgtacggttcgaacggtaccgtacggttacggtaccgacggacccgaacgggtccccg

SEQ ID NO: 376710 - DNA, 650 bp, Homo sapiens
  misc_feature: GZ8MTXP02HZZVB.11.12.B01.1.454.CMB.2.raw
  modified_base (196)..(196): a, c, t, g, unknown or other
  modified_base (247)..(247): a, c, t, g, unknown or other
  modified_base (257)..(257): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctcatcgtccgtcgtcccccgganagacacgccaccatcagctgctcgtggatatgtcttagactaatggtaatntcgtcttccnggtactacagacgaagaaggcacggccaccgccccctgtaccctactctacttacctttaacaaaactccgacggtccgccctcgtcggggtccctaggccgtcgtacgttccgtccggtcgtcccggcttcggtacgggaaccacgtacgtccgtactccgtcgactagtccgacggtccgggaaccacggtctagttgaacgtggtacggtctcgttaccttcgttcgtcggtcgtacgggacgtaggaaccaacgtgggtacggttcggggtaggtcccgggggacggtacgggaccgtcgggtcgtaaccggttacggttaccgtacggtaccgaaccggtcccggtaacgtcccgtcccgtcccccggtacgtcctaccggtttcccg

SEQ ID NO: 376711 - DNA, 572 bp, Homo sapiens
  misc_feature: GZ8MTXP02IXJD4.11.12.B01.1.454.CMB.2.raw
  modified_base (347)..(347): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagcctgctctggagatgtcttgactaatgagtatgcttcctggtatcagcagaggcaggccacgcccctgcctactcatcttacaaatccgaggcccgccctgtcggggtccctgacgcgntttccgccggtctcccggctcgtacggggaaccacgtacgtccactctacgacccactccgacggcccgggacccacggcttagttagattggaggtctcggtcttacgttctcgtccgagggcgtaggacaacgcggtcgtcggggttcggttcggggacgggtacgggaccgtaggtctaaccggtacggttcgttacggtccgacgacccgtaacggtcccg

SEQ ID NO: 376712 - DNA, 583 bp, Homo sapiens
  misc_feature: GZ8MTXP02FFGNU.11.12.B01.1.454.CMB.2.raw
  modified_base (195)..(195): a, c, t, g, unknown or other
  modified_base (318)..(318): a, c, t, g, unknown or other
  modified_base (327)..(327): a, c, t, g, unknown or other
  modified_base (338)..(338): a, c, t, g, unknown or other
  modified_base (360)..(360): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtgtcccccgganagacagccaccatcagctgctcgtggagatgtcttgactaatgagtatgcttctggtatcagcagaggcacggccacgcccctgtcctactcatcctttacaaaatcccgaggccgccctcgnggggtcccngacgcgtatcnccggtctccgctcgagggaacncgagtcactctgaccagtcacggcggacccaggtctagttcgagtgagtcttacggtcttacttcgtggtcgacggggcgtacggggaacaaacggtcggtacgggttgggtcgggttcggggacgggtacggggtaccctaggttacgacggtaccgttaccgtttacggccgacggcccgaacggtccctccggtcccccgttcggacctaccgtttcccg

SEQ ID NO: 376713 - DNA, 570 bp, Homo sapiens
  misc_feature: GZ8MTXP02FJFZ0.11.12.B01.1.454.CMB.2.raw
  modified_base (196)..(196): a, c, t, g, unknown or other
  modified_base (224)..(224): a, c, t, g, unknown or other
  modified_base (452)..(452): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtccccccgganagacacgccaccatcagctgctctgganatgtcttgactaatgagtatgcttcctggtatcagcaggagcacggccacgccccctgtcctactcattctttacaaaatcccgaggccggccctcgtcggggtcccctgaccgtcgtattcgtcccggctccggcttcgtacgggaaacacgagtccactctagaccatcgacggccggacccaggtctagttcgagtgacgtctcgtctacgttctgtcgacgggngtacggacaacgtgcggtggtcggttcgggcggacgggactaggtcgtacggaccggttcgttacgggcctacggaaccgaacggtccgtcccgtcccccgtggtccctactttcccg

SEQ ID NO: 376714 - DNA, 698 bp, Homo sapiens
  misc_feature: GZ8MTXP02HCOZM.11.12.B01.1.454.CMB.2.raw
  modified_base (196)..(196): a, c, t, g, unknown or other
  modified_base (490)..(490): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcacgcccaccctcatcgtccgtcgtcccccgganacgacacgccaccatcagctgctcgtggagtatgtctgactaagtgagtatgtcttccgtggtactcgagacgaaggaacggccacggcccacccgtcccctgtaccctactctaacttacctttaaacaaaactacccggacggtcccgtccccgttcgggtccggggtccctaggacccgtccgttaccgttcccgtcccgggtccgtccccgggtctaccgggtacgggaaacctacgtaccgtcctaaccgtcgtaaccgaccctatacccggacggtaccgggaacccnggttacttagtacgtacgtggacgtcgttgttacccttagttcgttacggcggtaggggtaccgggtacgaaacgtacgggtggtcgggttcgggtcggtacgggacggggtaacggtacgtacggtcgtaccggtaccgttacgtacggccgaacgcccggtaacggtcccgttacccggccccggttctacccgttacgttccccg

SEQ ID NO: 376715 - DNA, 699 bp, Homo sapiens
  misc_feature: GZ8MTXP02GSM1R.11.12.B01.1.454.CMB.2.raw
  modified_base (221)..(221): a, c, t, g, unknown or other
  modified_base (245)..(245): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcacgcccaccctccatcgtccgtcgtcccccggacagacacgccaccatcagctgctntggagatgtcttgaactatgagtntgtcttctgtatcagcagagcacggcccaccgccccctgtccctactctacttacctttaacaaaactcccgacggtccggtcccgtcggtcggggtcccctggacccgtcgtacttccgtcccggtccgtcccggtctccgggtacgggaaacctacgtacgtcctactcgacgaccacgtaccgacgggcccgggaacccgagtactagttacgagtcgggtacggtcttacggttacctttaccgttcgttacggtacggtacgggggtaccggtaacggggaacctaacgggtcgggtacggggttcggggttcggggtaccgggggaccggggaacggggacccgttacgggtccgtaccgggttaccggttacgtaacggttccgaaccggtaacccggtaccggtccccgtcccggtcccccgtaccggtcctacccggtttccccg

SEQ ID NO: 376716 - DNA, 671 bp, Homo sapiens
  misc_feature: GZ8MTXP02JG4WW.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccggacagacagccaccatcagctgctctggagatgtcttgactaatgagtatgcttcctggtatcagcagaaggcaggcccacgccccctgtccctactcattacttacaaaactcccgaggccgtccctcgtcggggtccctggaccgtcgtacttccgccggtctccggcttcggtacgggaactaccgtacgtccacgttcctacgaaccctcgtaccgaacggcccgggacccgagggtccttacgttgagttaggacggtcttcggttaccttacgtttcgtcggttacggacgggggtaccggttacggggaaccgtaaacggacgggttcgggtcgggttacgggttccgggggacggggaccggggtaccgtacggttccgtacggttaacccggttcgttaacgggtccgaaccggcccggtaaacggtcccgtcccggtcccccgtaccggttccctaccgtttccccgg

SEQ ID NO: 376717 - DNA, 600 bp, Homo sapiens
  misc_feature: GZ8MTXP02ITGH8.11.12.B01.1.454.CMB.2.raw
  modified_base (198)..(198): a, c, t, g, unknown or other
  modified_base (251)..(251): a, c, t, g, unknown or other
  modified_base (465)..(465): a, c, t, g, unknown or other
  modified_base (486)..(486): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtccccccgganagacagccaccatcagctgctctggagatgtcttgactaatgagtatgcttcngtatcagcagaaggcaggccacgccccctgtcctactcacttctttacaaaactacccgaggcccgccctgtccggggtcctggacgtcgtattcctcccggctcccggctccgtacgggaaccacgacgtccaacttcacgaccagtccgacggacccgggacccaaggtctagttagagtcggacgtcttgttccttacttcgtagttacgnggggtacgcgggaacaacggngtcgggttggttcgggtcgggcgggtacgggactcggtcgtacgtaccggttcgttaacggtcgaaaccggcccgaacggtcctcccggcccccgttcggtccctacggttccg

SEQ ID NO: 376718 - DNA, 725 bp, Homo sapiens
  misc_feature: GZ8MTXP02IRVOY.11.12.B01.1.454.CMB.2.raw
  modified_base (238)..(238): a, c, t, g, unknown or other
  modified_base (369)..(369): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatggtccgtcgtccccggacagacacgccaccatcagctgctcnggagatgttctgactaatgagtatgtcttctaggtatcgagcgagacggacgacggacccaccgccccttacgtccctacctctactttaccttaacaaactacgacggcccgtacccgtcgtcgggtccngacgctcgttccgtccggccgtccgcttacggtagggaaaccacgtacgtacctactacgttacgacctaacgccgaaccggggcccgggaaacccgtacgggtaccttaaggttagggtacgttaagggtaccggggttacctttcggttaacccgtttaccgtttacgttcgggtacccgggtaaacggggttccggggtaaaccgggaccgtaaaaccggtacgggttcgggttcggggttacgggggttccggggaaccgggggtaccgggggtaaaccctcgggttaaccgcggtttaccccgtttaggttaaaccggtccgaaccggtaccccgaacggtttccccccgg

SEQ ID NO: 376719 - DNA, 577 bp, Homo sapiens
  misc_feature: GZ8MTXP02H1D3E.11.12.B01.1.454.CMB.2.raw
  modified_base (214)..(214): a, c, t, g, unknown or other
  modified_base (249)..(249): a, c, t, g, unknown or other
  modified_base (285)..(285): a, c, t, g, unknown or other
  modified_base (410)..(410): a, c, t, g, unknown or other
  modified_base (434)..(434): a, c, t, g, unknown or other
tcagcgagagataccacgaccggtgctcgatttagtagtgtagattccgcggggtggaagaacctgcccagcctgggcctcaggaggcagcatcgggaggtgcctcagccatggcatggatccctctcttcctcggcgtccttgcttactgcacagaatccatggcctcctatgagttgactcagccaccctcatcgtccgtcgtcccccgganacgacacgccaccactcacgctcgctcgtaggatntcgtactagactagagtagtatcgtcttcgtgtacncagacgaaggacggcgacgccaccgtcccctcgtacctactactacttaccttaaacaaacgtccgacggccccgtccgtcggtcggctgcgcgtctccgcgcctcgctacgacgaacacactcnctcacacacacgacggaccgacgngtactagtagagtaggtgtctcgttcttacgtcgtcgtcggacggtacggacgacgacggtcggtacggttgggtcggtacgggacggacggacgtcggtccgtaacggtaccgttcgtacgacgaccggaccgtacggtccg

SEQ ID NO: 376720 - DNA, 722 bp, Homo sapiens
  misc_feature: GZ8MTXP02FMZNB.11.12.B01.1.454.CMB.2.raw
  modified_base (197)..(197): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtcccgtcgtccccccgganagacacgccaccatcagctgctctggagatgtctgactaatgagtatgtcttcctgtatcgagcagaaggcacggccaccgccccctgtcctactctattactttacaaaacgtccgacggccggtacccttcgtcggggtcccctggaccgcgtacgtccgtcccggtctcccggcttccggtacggggaaactacgtcgtactacctcgtacgacccacgtaccgaccgggacccgggacccgagggttacctaggttacgtacggttcggacgttccgttaggttcccttaacgtttcggtacggtacggtaaccggggtacgggtaaccggaaaccgaacggtacggggtacggggttcggggttccgggggtaccgggggaccggggaaaccgggtaccgttaacgggtttcccggaaccgggttacccggtttaccggttaaccggaccgtaaccccgggaaccggtaaccggttcccgacccggttcccccgtacggtaccccttacccgtttccccg

SEQ ID NO: 376721 - DNA, 582 bp, Homo sapiens
  misc_feature: GZ8MTXP02GMGJQ.11.12.B01.1.454.CMB.2.raw
  modified_base (349)..(349): a, c, t, g, unknown or other
  modified_base (419)..(419): a, c, t, g, unknown or other
  modified_base (546)..(546): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctcatcgtccgtcgtccccggacagacagccacatcagctgctctggatatgtcttgaactaatgagtatcgtcttcgtgtactcagacagagcacggccaccgcccctgtcctactctattacttaacaaactcgacgcccgtcctcggtcggtcccnggacgcgtcttccgccggtccgtccgtcttacgacgggaaacacgtacgtacacctcgtacgaacctacnccggaacggacccggggaacccagggtacctttaagtcgagtacggtacggtcttagtaccttacttcgtaggtcgaggcgttaacgggacaacgcggtcggttggtcggtcggacggtacggaccngttcaacgtacgtcgtacggcacgtacccagtcccg

SEQ ID NO: 376722 - DNA, 619 bp, Homo sapiens
  misc_feature: GZ8MTXP02GSQE6.11.12.B01.1.454.CMB.2.raw
  modified_base (419)..(419): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatcgtccgtcgtcccccggacagacacgccaccatcagctgctctggagatgtcttgactaatgatatcgtcttctgtatcagcagacggcacggccaccgcccctgtccctactctacttactttaaacaaactaccgacggtccccgtcccgtcgtccggggtccctggacgtcgtcgttccgtccggccgtccggtctcgtacgggaacacgagtccactcncgaccactccgacggacccggtaccagtctaagttcgagtggtaggtcttacggttaccttacgttcgtggtacgacgggtcggtacgggaacaacggtggtccgggttagggttcgggtcggggacggtacggggacccgtggttaccgtcgggtacccgttacgttacggggtccaaccggcccggtaacggtccccg

SEQ ID NO: 376723 - DNA, 601 bp, Homo sapiens
  misc_feature: GZ8MTXP02JXGD7.11.12.B01.1.454.CMB.2.raw
  modified_base (260)..(260): a, c, t, g, unknown or other
  modified_base (469)..(469): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctctccctcggcgtccttgcttactgcacagaatccatggcctcctatgagttgactcagcccaccctccatcgtcccgtcgtcccccggacacgacacgccaccatcagctgctcgtggatatgtctagactaangagtatgtcttcgtaggtatcagcaggacggcgacggccaccgtcccctgtaccctactctattacttaacaaactccgacggcccgtaccctcgtcgggtcctgacgcgtcttccgccggtccgtccgctcggtacgggaaacctacacgtaccacgtcgtacgacccatccgacggacccggaccaggtcttagtcgagtggacgtntacgtacttacttcgtggtaccgcggtaggtacggacaacggtggtcggttggtcggggtcgggacgggtacgggaccctggttccgcggtaccgttacggttacggaccaccggtaccggaacggtccccg

SEQ ID NO: 376724 - DNA, 628 bp, Homo sapiens
  misc_feature: GZ8MTXP02JSPJM.11.12.B01.1.454.CMB.2.raw
  modified_base (219)..(219): a, c, t, g, unknown or other
  modified_base (223)..(223): a, c, t, g, unknown or other
  modified_base (389)..(389): a, c, t, g, unknown or other
  modified_base (408)..(408): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacacgccaccatcagctgctcngganatgtcttagactaagtgagtatcgtcttccgtggtatcgagcgaaggaaggcacggcccaccgtccccctgttccctactctacttcttaacaaaactcccgaggtccgtccctcgtcggggccctggacgcgtactcgtccggctccggctcgacgggaacacgngtaccacgttccacgaccncgtaccgacgggacccgggacccagggtctagttggaagtcgagtcttacgtcctttacttcgtacgtcgcggggtacgtacggaaccgaacggcggttcgggttacgggttcggggttccgggacggggtacggaccgtacggttcgtacggaccgttacgtacggtcaaccggccgtaacggtccgtcccgcccccgtcggtactacccgtttccccg

SEQ ID NO: 376725 - DNA, 568 bp, Homo sapiens
  misc_feature: GZ8MTXP02JCN3H.11.12.B01.1.454.CMB.2.raw
  modified_base (221)..(221): a, c, t, g, unknown or other
  modified_base (465)..(465): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctgganatgtcttgactaatgagtatgcttcctggtatcagcaagaaggcaggccacgccccctgtcctactcatcttacaaaactccaggccgccctcgtcggggtcccctggacgcgtacttcgtccggctcccggctcgtaggggaaccacgagtccactctagaccatccgacggccgggacccaggcctagttgaagtgacgcttgtccttacttcgtagtcgagggtcgtagggaaccaaacgnggtcggtgggttggttcgggcgggtacgggaccgtagtcgtaggacccgttgtacggtcgaacgtccccgaaggtcctccggccccgtcggtccacgtttccg

SEQ ID NO: 376726 - DNA, 740 bp, Homo sapiens
  misc_feature: GZ8MTXP02H0DHY.11.12.B01.1.454.CMB.2.raw
  modified_base (442)..(442): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacaggattcggtggcctccgatgagttgactcagcccaccctcagttcgtccgtcgtcccccaggacacgacagccagaactcccctgcctctaggaattgaattgaagagaataaatattacttgttaggtatacaacagaagccaggccacgtcccctgtacttcggtacattactactacaagtattaggtaggaacggccggtccctacggacggggaccttcccggagacgtcgttacttccgtcgtacggtaccctacccgtaaccgttcggtaacgggaacccncgacgaccctactacctacgaaccctagtacccgaacgggacccgggacccgaggtacttaacgggtacggaacgtacgggtacggtcgttacggttaacgtttaacgtttagttacgggtttaaccggacgggggttacggggttaaccggggaacgacggtacgaaccggtccgttaaaccggttccggttaacccgttttacggttacggtttaccggttaaccggggtaaacggttccggggtaaaacccgtacgggttacccgttaaacccggtttcgttaaccggtaaccgg

SEQ ID NO: 376727 - DNA, 658 bp, Homo sapiens
  misc_feature: GZ8MTXP02HZUHB.11.12.B01.1.454.CMB.2.raw
  modified_base (212)..(212): a, c, t, g, unknown or other
  modified_base (240)..(240): a, c, t, g, unknown or other
  modified_base (255)..(255): a, c, t, g, unknown or other
  modified_base (260)..(260): a, c, t, g, unknown or other
  modified_base (319)..(319): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcagccaccctccatcgtccgtcgtccccgganagacagccaccatcagctgctcgtgganatgtcttagactaangatantcttctgtatcagacagaacggcacggcccaccgcccctgtccctatctattaccttanaaaacgtcgacggtccccgccttcggcgggtccctgacgtcgtgtttccgccggtcctcccgggctcggtacgggaacctacgacgtccacgtctacgaacctacgtccgacggaccggggaacccctagggtaccttaaaggtttcggaaagtttcgggtaacggttccgtttacggttacccttaacgtttccggtaacgttccgggagggttccgtaacgggaaaccacggtacggtcgggttacggggttcgttacgggggaccggtacgggtaacctggttaccgtcggtaccgtttacggtcggtaccgacccggtaccggtacggtcccccg

SEQ ID NO: 376728 - DNA, 693 bp, Homo sapiens
  misc_feature: GZ8MTXP02HX0M0.11.12.B01.1.454.CMB.2.raw
  modified_base (197)..(197): a, c, t, g, unknown or other
  modified_base (224)..(224): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctgganatgtcttgactaatgagtatcgcttctggtatcagcagaacggcgacggccaccgcccctgtcctactctattacctttacaaaacgtaccgacggtccgtccccgttacgggttccggggtccctggacccgtcgttaccgttcccgtccccgggtccgttccccggtcttcgggtacggggaaaccacgtacgttacctacctcgtacgaccctacgtccgacgggaccgggaccctagggtacttagtgagtaggcgtactcggttaccttcttcgtcggtacgtaggggtacggtacgggaccgaacggtcggtcggttggggttccggggtacgggggtaccggggacggtaccggtacgtaccggttcggtaacccggttcgttaccgggtaccgacccggtaacccgtaaccggggtcccgtccccggtcccccggttcgttcccgtacccgtttcccccgg

SEQ ID NO: 376729 - DNA, 694 bp, Homo sapiens
  misc_feature: GZ8MTXP02HQNCV.11.12.B01.1.454.CMB.2.raw
  modified_base (196)..(196): a, c, t, g, unknown or other
  modified_base (224)..(224): a, c, t, g, unknown or other
  modified_base (251)..(251): a, c, t, g, unknown or other
  modified_base (256)..(256): a, c, t, g, unknown or other
  modified_base (377)..(377): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctcatcgtcccgtcgtccccgganagacacgccacatcagctgctcgtgganatgtcttagactaatgagtatgtctcnggtancagcagagcacgccaccgcccctgtccctactacactttaccttaacaaaacgtccgacggtccggtaccctcggtccggggtacctggaccgtcgtacttccggtccggcgttcccggtntccggtacgggaaactacgtacgtactcgtactacgacctacgaccgacggaccgggacccgtagggtaccttagttgagttcggacggttcttcgttcctttacgttcggttacggtaggtacggggtacgggtaacgggaacgaacggtcggggtgggttcggggttcggggttaccgggggacggggttaccggggaaccgttagggtccgttacggttaacccgggttgtaccgggttaccgaccggtaacccggaaccggttccccggtccccggtacccccggttccggttacccgtacccgtttcccccg

SEQ ID NO: 376730 - DNA, 660 bp, Homo sapiens
  misc_feature: GZ8MTXP02JDS7M.11.12.B01.1.454.CMB.2.raw
  modified_base (197)..(197): a, c, t, g, unknown or other
  modified_base (220)..(220): a, c, t, g, unknown or other
  modified_base (224)..(224): a, c, t, g, unknown or other
  modified_base (371)..(371): a, c, t, g, unknown or other
  modified_base (376)..(376): a, c, t, g, unknown or other
  modified_base (382)..(382): a, c, t, g, unknown or other
  modified_base (393)..(393): a, c, t, g, unknown or other
  modified_base (398)..(398): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatgtcccgtcgtcccccgganagacacgccacatcagctgctcngganatgtcttgacttaatgatatgtcttccgtgtatcagacaaggaacggcacggcccaccgtccccctgttcctactctacttccttaacaaaacctccgaggccgtcccctgtccgggtcctggaccgctattccgccggctcccggntcggnggaacncgatccactcncgacntcgacggtccggaccagtctgtacgtagtggacgtcgttcgttacctcttcgttcgtcggtagggtaccggtaggtaacgaccgtagggtcgggtttcggggtcgggttacggggacgggtacggtacccggtacggttaccggtaacggttacccggtttactaccggggttaacccgaacccggaacccgggttaaaccggtcccccgttacccgggtaccccccgtttccgggtttacccctacccgtttttcccccgg

SEQ ID NO: 376731 - DNA, 669 bp, Homo sapiens
  misc_feature: GZ8MTXP02H0QX1.11.12.B01.1.454.CMB.2.raw
  modified_base (215)..(215): a, c, t, g, unknown or other
  modified_base (276)..(276): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganacgacacgccaccatcagtctgctcgtggagtagttgttacttacgaactaagtggtagtntcgtccttcgtagtatcgagacgaaggacgcgacggcccaccgtccccctgtcctactctacttactaacaaactccgacggccccgtcccgtcggtccggtcctgacgtcgtcgttccgtccggtccgtaccggcttacgtacggaacctacgacgtacctacgtcaccgaaccacgtaccggaaccggacccgggacccgtacggtacgttagtacgtacggtcggtacgttccgttacgttaccttaccgttcgtcggtacggacgggtacggtacggaaccgtaacggtcgggtcgggttcgggttacgggtaccggggacggtaccggtaccgtaggtccgtaacggttaccgttacgtaccggtacgacccggtaccgacggtcccg

SEQ ID NO: 376732 - DNA, 750 bp, Homo sapiens
  misc_feature: GZ8MTXP02IEK36.11.12.B01.1.454.CMB.2.raw
  modified_base (237)..(237): a, c, t, g, unknown or other
  modified_base (261)..(261): a, c, t, g, unknown or other
tcagcgagagataccacgaccggtgctcgatttagtagtgtagattccgcggggctgggcctcaggaggcagcatcggaggtgcctcagccatggcatggatcccctctcttcctcggcgtccttgcttactgcacagaatccatggcctctatgagttgactcagcccacctcatgtccgtgtcccccggaagacagccaccatcagctgctcgtggatattgtcttagacttaangtaagtctgtctcgtgtatcacgnagacggtcacggcccacgtccccctgtctactctattctttaacaaaagttcccgagggtcccgcccgtagtccggggtactgaccgtcgtacgttcccgccggttctaccggcttcggtaccggaactaccggtctaccctactcgtacgtaccgttacaccggaacgggccccggggtaaaccctaggggtaccctttaaggttacggaacggtaaggtaccggttacctttcgggttaaccttttcccccgttaagggttcggtttaacccgggaaaggggtccggtttaaaccgggggaaactaaacccgggtgggttaccggggtttacggggtcggggttccgggggaaaaccggtcgggttaaaccgcgggtttccgtaaccccgggtaaaggtttcgtaaaaccggggttcccaacgtaacccgggtacgtccccgtcccggtaaaacccccggttttcggaaccttaccggtttcccccg

SEQ ID NO: 376733 - DNA, 645 bp, Homo sapiens
  misc_feature: GZ8MTXP02HM9MR.11.12.B01.1.454.CMB.2.raw
  modified_base (214)..(214): a, c, t, g, unknown or other
  modified_base (283)..(283): a, c, t, g, unknown or other
  modified_base (310)..(310): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccatcgtccgtcgtccccgganagacacgccacatcagctgctcgtggagatgtctagactaatgagtatcgtcttccgtggtactcgagngaagacggcacggcccaccgtcccctntaccctactctattaccttaacaaactaccgacggtccccgtccccgtcggtccggggtccctaggacgtcgtacgtttcccgtcccggtccgtcccggtccgtaccggtacgggaaacctaccgtacgtccctacgtctaccgaacctacgtcgaccggaccgggaccacggtctagtgagtcggagttctagttccttacttcggtacgtcggtgggacggtacgggacaacggtacggtcgggttagggtcggttaccgggggacggacgggtacgtacggtcgtaacggtccgttcggttacggccgaccggtaccggtaccggtccccgg

SEQ ID NO: 376734 - DNA, 658 bp, Homo sapiens
  misc_feature: GZ8MTXP02I5CZJ.11.12.B01.1.454.CMB.2.raw
  modified_base (197)..(197): a, c, t, g, unknown or other
  modified_base (227)..(227): a, c, t, g, unknown or other
  modified_base (231)..(231): a, c, t, g, unknown or other
  modified_base (245)..(245): a, c, t, g, unknown or other
  modified_base (254)..(254): a, c, t, g, unknown or other
  modified_base (403)..(403): a, c, t, g, unknown or other
  modified_base (424)..(424): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganacgacacgccacatcagctgctcgtggatntgtnttgactaatgagtntcgtcttcngtatcagcagacggcacggcccacgtccccctgtaccctactctattaccttaacaaaactcccgacggcccgtcccgtcggtcggggtcctgacccgcgtacttccgccggctcccggctcgacgggaacacgcgtcactcacgaccngtaccgacggccgggaacccnggtacttagtcggaagtcggacggtcttcggttacctttacgttccgttcgccgggtagggtacggtaccggaaactaccgggtgggtcggtggggtttcgggaccggggtacgggacggggtaaaccttcggggtccgttaacggggtacccgtttcgtaaacccggggtccacggtaaccccgtcggtcccgttaccccggtcccccgtggttaccctaccgtttcccccgg

SEQ ID NO: 376735 - DNA, 618 bp, Homo sapiens
  misc_feature: GZ8MTXP02GRI8V.11.12.B01.1.454.CMB.2.raw
  modified_base (196)..(196): a, c, t, g, unknown or other
  modified_base (224)..(224): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccaccatcagctgctcgtgganatgtcttgactaatgagtatgtcttccgtggtatcagcaggagcacgccacgccccctgtcctactctattctttaacaaaactcccgacggccgtccctcggtcggggtccctggaccgtcgtacttccgccggctcccggctccggtacgggaacctacgtacgtcctactcgtacgacctagtccgacgggaccgggtacccaggtacttagttgagtcggagtcttagttacttacgttcgtgtcgagggtacgtaggaacaacggtggtcggtagggttcgggtcgggacgggtacggaccgtaggtccgtacggtaccgttcgttaacggccgaccggtaacccgaacggtccgtacccggtccccgtcggacccttaccgtttcccg

SEQ ID NO: 376736 - DNA, 589 bp, Homo sapiens
  misc_feature: GZ8MTXP02JS9QU.11.12.B01.1.454.CMB.2.raw
  modified_base (216)..(216): a, c, t, g, unknown or other
  modified_base (264)..(264): a, c, t, g, unknown or other
  modified_base (273)..(273): a, c, t, g, unknown or other
  modified_base (321)..(321): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtcccgtcgtccccccgganagacagccaccatcagctgctcgtggagatgtcttgaactaatgagtngtccttcgngtatcagcagaggcaggccacgtccccctgtccctatcattccttaanaaaactcgcgccccgcctcgtcggggccctgacgcgtctccgtccggtcctccggcttcggtacgggaaacacctacgttcaccgtctacgaccctagtcccgacgggcccggaacctacggtcttaagttcggaatgggacggtctggttaccttcgttcgtagtcgacggggtcggtacggaacacgtgcggttaggtcggtacgggcggtaccggcctacggtcgtaacggtccgttacgtacgtccgacggacccgagtccccg

SEQ ID NO: 376737 - DNA, 622 bp, Homo sapiens
  misc_feature: GZ8MTXP02I18Q2.11.12.B01.1.454.CMB.2.raw
  modified_base (242)..(242): a, c, t, g, unknown or other
  modified_base (272)..(272): a, c, t, g, unknown or other
  modified_base (367)..(367): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatcccctctcttcctcggcgtccttgcttactgcacagaatccatggcctcctatgagttgactcagccaccctccatcgtccgtcgtccccccggaagacagccaccatcagctgctctgganatgtctgactaatgatatgctctaggtatnagcaagacggcacggccacgccccctgcctactctaattcctttaacgaaaactcccgaggcccccgtcccttcgtcggggttccctgacgcgtntttcccgccggactccgggctacggtcggaactacagtccactctacggaccctagccacggcccgggacccagggtccttaagttcgaagtggacggtcctaggttaccctaaagttcgtacggtacgacgggtacggtacgggtaacaaacggtcggtacggttggggtacggtcggggacgggtacggtaccgtacggtccgtaacggtaacccgtcgttacggtaccgaccggccccgtaacggtcccccg

SEQ ID NO: 376738 - DNA, 719 bp, Homo sapiens
  misc_feature: GZ8MTXP02IPD4G.11.12.B01.1.454.CMB.2.raw
  modified_base (197)..(197): a, c, t, g, unknown or other
  modified_base (225)..(225): a, c, t, g, unknown or other
  modified_base (571)..(571): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgccaccatcagctgctctgganatgtcttgactaatgaatatgtcttcgtggtatcagcgaaggaacggctacggaccccaccgtccccctgtccctactctaacttactttaacaaaacttacccgaggtcccgtccccttcggtccggggtccctggaccgtccgtacttcccgtccggtcccttcccgggcttcgggtacggaaacctaccgtaacgttccacgtacgtacgaacctacgtaccggacggaccccgggaacccgtaagggttaccttaggttacgtagtacgggtacgttccttcggttacctttaccgttcgttacgaccgggtggggtaaccggttcggggaaactaaccggngggttcgggttagggttacgggtccgggggtacggggtaaccgggaccgttaggtcccggttacggtacccgtttacggtaccggtccaacgggttaacccacggggtccctcccgggtacccccgttcgtaccctaccgtttccccg

SEQ ID NO: 376739 - DNA, 661 bp, Homo sapiens
  misc_feature: GZ8MTXP02GQ17W.11.12.B01.1.454.CMB.2.raw
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagccaccatcagctgctctggagtatgtcttgactaagtgagtatgtcttctggtactcgagcagaacggcacggccacgccccctgtaccctactctacttacttaacaaaactaccgacggccccggtcccttacgtcggggtccctggacgtcgtcgttccgtccggccgtacccgcctacggtacgggaacctaccgacgtcccactcgtacgaccctagtccgacggacccgggaacccacggtccgttaagtacgtaacgtcggtaacgtcgttcgttccgttaaccttcgttcggttccggacggtccgggttacggaacctaacggtacggtcgggtgggttcgggtacggggacggggtaccggtaaccgtcggttacggtcggttacccggttacgttaccggtcgtaacccggtacccgtaacggtcccccg

SEQ ID NO: 376740 - DNA, 596 bp, Homo sapiens
  misc_feature: GZ8MTXP02F3VWZ.11.12.B01.1.454.CMB.2.raw
  modified_base (214)..(214): a, c, t, g, unknown or other
  modified_base (380)..(380): a, c, t, g, unknown or other
  modified_base (420)..(420): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagaccagccaccatcagctgctcgtggatatgtcttgactaatgagtatgcttctggtatcagcagagcaggccacgcccctgcctactctacttacttacaaactccgacggcccgtccctcgtcgggtcctgacgcgtcttcgccgctccgctcgacgggaacncgacgtccacgtctcgaccatcgacgaccgtacggacccnggacttagtagaacgtggagtctcgttaccgtctttcgtacggtacgtagggtaccggtaggggaaacctaacggcgggttccggttggggttccgggttacgggggccgggaaaacgggtcccgtaaggtccgtacggtacccgttggtaccggtacgaccgacccgtaaccggg

SEQ ID NO: 376741 - DNA, 667 bp, Homo sapiens
  misc_feature: GZ8MTXP02IPUZ5.11.12.B01.1.454.CMB.2.raw
  modified_base (198)..(198): a, c, t, g, unknown or other
  modified_base (205)..(205): a, c, t, g, unknown or other
  modified_base (228)..(228): a, c, t, g, unknown or other
  modified_base (263)..(263): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtccccccgganagacacncccaccatcagctgctcgtgganttgtcttgaacttaatgagttatgtcttctggtancagcagaaggcgacggcccacgccccctgtccctactctattcctttaacgaaaactcccgaggcccgtccctcggtcggggtcctggacgtcgtacttccgtcccggcttcccggacttcggtacgggaaacctacgtacgtcctacgttccacgtaacccagtacccgacgggacccggggaccccgagggtacctagttagacgttaggacggttcttcgttccttacctttcggtgtaccggtacgggtccggtacgggaacctaacggtggtcggttggggttacgggtacggggccgggtaacgggaccgtacggtccgttacggtaccgttacgttacgtacccgacgaacccgtacggtcccgtcccgtcccccgttcgtaccctaccgtttcccg

SEQ ID NO: 376742 - DNA, 789 bp, Homo sapiens
  misc_feature: GZ8MTXP02H01R8.11.12.B01.1.454.CMB.2.raw
  modified_base (213)..(213): a, c, t, g, unknown or other
  modified_base (240)..(240): a, c, t, g, unknown or other
  modified_base (278)..(278): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggtcctcctatgagttgactcagccaccctcatcgtccgtcgtccccgganagacagccacatcagctgctcgtgganattgtcttagactaagtgtagtatgtccttactgttanacgagacgaaggaacggcgaccggcccacgtcccccggttataccctactccgtaacttaccgtttaaaacaaacctaaccgcgggtaccccccgtccccgttcggtccggggacctggaccggtcgttaccgtttccggccggtcccgttacccggtcgttacggtacgggaaacccacgtaccgtactaccgtcgtaccgtaacccgacgttaccggacgggaaccccggggtaacccgtacggtactttaaacggttcgtaaggtacgggacggtttaccgttcggttaccctttaaccgtttccggtcgggtttaacccgggcgggttaacccgggttacgggggtaaaaccaaaaccggggttcgggtaaccggggtttcgggggtacggtttacccgggggacggggaaccgggtaccggttaaaccggtccgtttaacccgggttaaacccgtttaccgggttaacggtaccccggtaacgaaccccgggtaacgtcccccggg

SEQ ID NO: 376743 - DNA, 614 bp, Homo sapiens
  misc_feature: GZ8MTXP02G7I7I.11.12.B01.1.454.CMB.2.raw
  modified_base (213)..(213): a, c, t, g, unknown or other
  modified_base (241)..(241): a, c, t, g, unknown or other
  modified_base (484)..(484): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctcatcgtccgtcgtccccgganagacacgccacatcagctgctcgtgganttgtcttagaactagtgagtatcgtctccgtggtactcgagtcaaggaggcacggcccacgcccctgtcctactctaacttcttaaacaaaactcgacggccccgtaccctcggtcgggtcctggactccgtctttccgccggtccgttcccgtacgttcgacgggaaacctacgactcactcgacgtacctagcgacgggccggaccagtactagtgacgtagtgcttcgtacttcgtcggngttacggaggtccggtaggaacccagtcgggtcggttggggtcggtacggggacgggtacggtaaccgtcggttaccgtaaccggtaccggtacggttcggacccgtacggaccccgtaacggtcccccg

SEQ ID NO: 376744 - DNA, 756 bp, Homo sapiens
  misc_feature: GZ8MTXP02ISKNK.11.12.B01.1.454.CMB.2.raw
  modified_base (212)..(212): a, c, t, g, unknown or other
  modified_base (342)..(342): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtcgtccccgganagacacgccaccatcagctgctctggagatgtcttagactaagtgagttatgtccttccgtaggtatcgagcaaggaaggcaggcccacgtccccctgtccctactctacttcctttaacaaactaccgnggccccgtcccgtcgtcggggtccctggacgtcgtcgttccgtcccggtccgttccccgggccttacggtacggggtaacccacgtacgtcctacctccgttacgaacccaagtcccggaacggggccccgggaaacccgtacggtcttaaagtttggtaaacggttcggtaggggttccctttacgttacccgtttaccgtttccggtacggttccggtacgggggttccggggttacggggaaacccggtaaaaccggtacggggtcggggttttcgggggttcggggtttaccgggggaccgggggtacgggggttaaaccccgtgggtttacccgtaacgggtttaccccggttaccggttttaacgggtaccggaaacccgggtaccccggaaacggggttccccccgg

SEQ ID NO: 376745 - DNA, 651 bp, Homo sapiens
  misc_feature: GZ8MTXP02H70NA.11.12.B01.1.454.CMB.2.raw
  modified_base (196)..(196): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcagcccaccctccatgtcccgtcgtcccccgganagacagcccaccatcagctgctcgtggagattgtcttagactaagtgagtatgcttccgtggtatcagcaagaacggcacggcccacgccccctgtcctactacctattactttaacaaaactccgacggccgtccctcggtccggggtcctgacgcgtacttccgtccggctccggctcggtacgggaaactcgagtacctctctacgaccctagccgacgggcccgggaaccgaggtaccgttagttaggagtcgggtacgttcgttcggtttacctttaccgtttgttcggtacgggtacggggtaccggtacgggaaacccgaaggtcgggtcgggttgggggtcggttcgggggacggggacggtacgtaggtcgtacggtaaccgttcggtacggtccacggaacccgacggccgtacccggtcccgtacgggtcctaccgtttccccg

SEQ ID NO: 376746 - DNA, 615 bp, Homo sapiens
  misc_feature: GZ8MTXP02JC62Q.11.12.B01.1.454.CMB.2.raw
  modified_base (216)..(216): a, c, t, g, unknown or other
  modified_base (242)..(242): a, c, t, g, unknown or other
  modified_base (246)..(246): a, c, t, g, unknown or other
  modified_base (263)..(263): a, c, t, g, unknown or other
  modified_base (388)..(388): a, c, t, g, unknown or other
  modified_base (464)..(464): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcacgccaccctccattcgtccgtcgtcccccgganagaccagcccaccatcagctgctcgngganattgtcttgacttaaangagttatcgtcttccgtaggtatccaagcgaaggacgggccacgggccccaccgcccccttgtccctaactcactttccttaaacaaactccgaggcccccgtcccgtgtcggggtccctggacncgtcgttccgcccggcgtcccgcttaccgagggaacccactacgtacctactctacacacgccgacggccggaccngtactagtgagtgagtctagtaccttagttcgtgtcgaggtcggacggaactacggagtcggttgggtcgggttaccgggacgggtacgggtaaccgtcggtaccgtcggtaccggttcgtacggtcgtaccgacccggaacggttccccg

SEQ ID NO: 376747 - DNA, 699 bp, Homo sapiens
  misc_feature: GZ8MTXP02HLCZL.11.12.B01.1.454.CMB.2.raw
  modified_base (212)..(212): a, c, t, g, unknown or other
  modified_base (240)..(240): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctcatcgtccgtcgtccccgganagacacgccaccatcagctgctctggantgtctgactaatgatatgtcttctggtatcagacagaaggcacggccacgtcccctgtacctactctacttactttaacaaaacttaccgacggtcccccggtaccccttcggtaccggggtcccttagggaccgtccgtaccgtttcccgtccgggtcccgtacccgggtccttaccgggtacggggaaaccctacgtacggtaccctacgtacctacggtaaccctacgtaccgacggtaccccgggaacccgaggtaccttagtcggtataggtacgtcttacggttaccttacgttcgttacggtcgtacggggtcgtacgggaacgtacggacggttcgggttagggttcggtacggggacgggtaccggggtaccgtacggttccgttaaccgggtaccggtttaccggttaccgggtaccgtaaccggtaccccggtaacggtttcccccgg

SEQ ID NO: 376748 - DNA, 584 bp, Homo sapiens
  misc_feature: GZ8MTXP02FJSIK.11.12.B01.1.454.CMB.2.raw
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccaccatcagctgctctggagatgtcttgactaatgagtatgcttctggtatcagcagagcaggccagcccctgtcctactcatcttacaaaataccgacggcggccctcgtcggggtccctggacgcgtactctccggctccggctcgtcgggaacacacgtaccactcgtcgaccatcgacgcgggacccaggctagtgatggagtctagtctacttctgtcgagggcgtacgggaactaacgtaggcggttacgggttcggttcgggggcgggacgggtaccgacggttcggaccggtaccggttaccgtttacgggcccgtaacggccccgaaacggtccgtacccggtccccccgtcgggtaccctaccgtttccccg

SEQ ID NO: 376749 - DNA, 728 bp, Homo sapiens
  misc_feature: GZ8MTXP02GLYXJ.11.12.B01.1.454.CMB.2.raw
  modified_base (213)..(213): a, c, t, g, unknown or other
  modified_base (245)..(245): a, c, t, g, unknown or other
  modified_base (642)..(642): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctctatgagttgactcacgccaccctcatcgtccgtccgtaccccganacgacacgccacatcagtctgctcgtaggatntgtactagactatgtatatcgtcttcgtaggtactacgacgacgaaggacggccgaccggacccgtacccgtccccgttcgtacccttactactactttacctaaacaaacgtcccggacggtccccccgtcccgtcgggtccggtccctaggtaccggtacttcgttccccggtccggccgttccccgggtacgtacggtaaccgggaaacctaccgtacttaccccgtactaccggttaccaacccgtacgaccgaacggtaaccccgaacccggggtaccgtaacggtttaccgttagggttaaacggtcggttacgggacggggttaccctttacgtaccccgtttacgttcggtaccggttacgggacgggtacggtacggaaactacgggngggttccggttagggtaccggtggggaccggtaccggtagtcgtaaccgtacggtacgttccgtaggaccgtacgacccggtccgg

SEQ ID NO: 376750 - DNA, 649 bp, Homo sapiens
  misc_feature: GZ8MTXP02IDMKC.11.12.B01.1.454.CMB.2.raw
  modified_base (219)..(219): a, c, t, g, unknown or other
  modified_base (258)..(258): a, c, t, g, unknown or other
  modified_base (266)..(266): a, c, t, g, unknown or other
  modified_base (375)..(375): a, c, t, g, unknown or other
  modified_base (469)..(469): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctctatgagttgactcacgcccaccctcatcgtcccgtcgtccccccggaagacacgccacatcagctgctntaggagattgtcttagacttaaatgagtatcggtcttcnggttaacncgagagaaggacggcgaccgcccaccgtccccttcgttacctacctacttaactttaccttaaaacgaaaccgtacccggcgggtcccgtcccgtcgggtccggtccgngtaccgtccgtccgtccgccggtccgtaccgcgtcggacggaacctcgtactccactacacaccacgccgacggtccgacgtgtacgtatgagngtacgttcttacgttacttcgtgttgacggtacgggtcggtacggaacgtcggtcggtgggttcggggtacggtcggggaacggtaacggtacggtcgttacgttaccgggtacgtttacgtaccggaccgaccggtaacccgcggtccgcccggttccccggtacgttctcccgtcccg

SEQ ID NO: 376751 - DNA, 638 bp, Homo sapiens
  misc_feature: GZ8MTXP02HLFGG.11.12.B01.1.454.CMB.2.raw
  modified_base (196)..(196): a, c, t, g, unknown or other
  modified_base (223)..(223): a, c, t, g, unknown or other
  modified_base (255)..(255): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccaccatcagctgctctgganatgtcttgactaatgagtatgtcttctggtancagcagaggcaggccacgccccctgtccatctatcttacaaaatcccgaggccgtccctcgtcggggtccctggacgccgtgtcctcccggctcccggctcggtacgggaaccacgaccgtactaccgtctacgacctatccgacgggtccggaccctaggtactacgttgaagtcgtacggtcttacgttacgtttacgtcgttacggtccggaggggtaccggttacgggaaaccgtaacgacgggttcgggtcgggttgggtaccggggcggggaacggtccggtaagtccgtacggttaaccggttcgttacggtaacccgtcggaaccccggtaggtccccgttccggcccccggtttacggtcctacccgtttccgg

SEQ ID NO: 376752 - DNA, 614 bp, Homo sapiens
  misc_feature: GZ8MTXP02G3ZUB.11.12.B01.1.454.CMB.2.raw
  modified_base (239)..(239): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagccaccatccagctgctcgnggagatgtcttgactaatgagtatgcttcctggtatcagcagaggcaggccacgccccctgtcctactcattccttacaaatccaggccccgtccctcgtcgggtaccctggacgcgtcttccgccggtccgtccggctacgtacgggaaccacgacgtccaacgtctacgacccagtaccgacggccggggaacccaggtcttagttacgagttcggacggtcttacggtccttacgttcgtaccgtcgagggtccggtaagggaaccaaacggtggtccgggttgggtcggtaccggggacgggacgggtaccgaaggtttccgaacggtacccgttaggtaccggtaccgaccgaccccggtaaggtccccg

SEQ ID NO: 376753 - DNA, 649 bp, Homo sapiens
  misc_feature: GZ8MTXP02F8GV1.11.12.B01.1.454.CMB.2.raw
  modified_base (212)..(212): a, c, t, g, unknown or other
  modified_base (243)..(243): a, c, t, g, unknown or other
  modified_base (318)..(318): a, c, t, g, unknown or other
tcagcgagagataccacgaccggtgctcgatttagtagtgtagattccgcggggtggaagaacctgcccagcctgggcctcaggaggcagcatcggaggtgcctcagccatggcatggatccctctcttcctcggccgtccttgcttactgcacagaatccatggcctcctatgagttgactcagccaccctcatcgtccgtcgtccccganagacacgccaccatcagctgctcgaggagtntgtcttgaactaatgacttatcgtcttcgtaggtatcagcgaagacggcacggcccaccgtcccctcgtcctacnctactcttaaacaaactccgacggccccgtaccctcggtcggccgtcgaggctcttccgcgtcccgtccggctcgaggacctagtcgtcactcgtccgaactcgccgtaacggccggaccaagtccttagttcggacgtcgggtacttccgtacgtttaccgtacctttcggtaagtccgggtacgggttccgggaaaccggttacgaaaccggtccggtggggtttacggggtcgggtttaccgggggaaccggggtacggtaacccgtcggttaccgttccggttacgttaccggttacggaccacgggtaccccgaacgttcccccgg

SEQ ID NO: 376754 - DNA, 533 bp, Homo sapiens
  misc_feature: GZ8MTXP02FLR3T.11.12.B01.1.454.CMB.2.raw
  modified_base (195)..(195): a, c, t, g, unknown or other
  modified_base (264)..(264): a, c, t, g, unknown or other
  modified_base (376)..(376): a, c, t, g, unknown or other
  modified_base (440)..(440): a, c, t, g, unknown or other
  modified_base (466)..(466): a, c, t, g, unknown or other
  modified_base (485)..(485): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatcatggcctcctatgagttgactcagcccaccctcatcgtccgtcgtcccccgganagacacgccaccatcagctgctcgtggagattgtcttagactaatggacgtatgtcttctgtactcagnagagcacgccaccgcccctgtccctactcgtacttactttaacaaaactccgacggtccgtccctggtacgggtccctagaccgctctcgccggcgtccgctcggcgaactnacgctactcgacgacagtccgacggaccggtaccagctagtgatgacgtcttcgtctacttcgngtcgaggtcgtacgacagcggtcggngtcggtcgggcggtacgcngtacgtcgtcgttacgtcacgacgccgacgcctcgccctcgctcgtcc

SEQ ID NO: 376755 - DNA, 651 bp, Homo sapiens
  misc_feature: GZ8MTXP02HMHCG.11.12.B01.1.454.CMB.2.raw
  modified_base (197)..(197): a, c, t, g, unknown or other
  modified_base (252)..(252): a, c, t, g, unknown or other
  modified_base (269)..(269): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganacgacacgccaccatcagctgctcgtggagtatgtcttagaactaagtgaagtancggtcttccgtggttancagcgaaggaaggcgacggcccaccgtccccctgtccctactctactttacctttaacaaaacgtcccgacggccgccctcggtcgggtccctggaccgtcgtacgttccgtccggcgtccggtctcggtacgggaaccacgtacgtcctacgtcgtacgaccactaccgacggcccgggaccctaggtacttagtagagttggacggtcttacggttcctttaacgttcgtacgtcgtacgggtcggtacggaacgaacggtacggtcggttacgggtcgggtacgggacgggtacggaccgtacgtccggtacgtaccgttcgtacggtaccacggaacccgtacggtcctcccgaccccgtcgtaccgtcctttccccg

SEQ ID NO: 376756 - DNA, 600 bp, Homo sapiens
  misc_feature: GZ8MTXP02I05RO.11.12.B01.1.454.CMB.2.raw
  modified_base (219)..(219): a, c, t, g, unknown or other
  modified_base (346)..(346): a, c, t, g, unknown or other
  modified_base (496)..(496): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctcatgtccgtgtcccccggaagacagccaccatcagctgctctgganatgtcttgactaatgatatgcttctgtatcagcagaagcaggccacgcccctgtaccctatcaattcgtttaacaaaactccgaggccgtcccctcgttacggggtccctaggacgccgtactttcncccgggtctcccggactcggtacgggaaacctcgtacgtcctaacgtctaccgacctagtccgaacggaccggtacccgagtacctagttgaagtggaaggtccttagtccttaacgttcgttagcgtagggccgtaagggacaacgggnggtacggtggtacggtacgggacggtaacggtccgtacgtcgtcgtacgttacgtacgcgaccggaaccgtacgtccgtccgaccccgtcgaccgttacgtccg

SEQ ID NO: 376757 - DNA, 595 bp, Homo sapiens
  misc_feature: GZ8MTXP02GI2B6.11.12.B01.1.454.CMB.2.raw
  modified_base (196)..(196): a, c, t, g, unknown or other
  modified_base (489)..(489): a, c, t, g, unknown or other
tcagcgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccaccatcagctgctctggagatgtcttgactaatgagtatgcttctggtatcagcagaagcaggccagccccctgtccctactcatactttacaaaatacccgaggtccggccctcgtcggggtccctgaccgtcgtacttccgccggtctcccggctcggtacgggaaacacgagtccactctacgacctagtaccgacggccgggaacccagggtactacgttgaagtgacgtcttcggttccttacttccgttgtcgtaacggggcgtacggggaacaacggnggtcggtgggtcggtcggggacggacgggtactacggtcgtacggtaccgttcgtacggtcgaacgaaccgacggtccgtaccgtacccgtcgtacctaccgtccg

SEQ ID NO: 376758 - DNA, 568 bp, Homo sapiens
  misc_feature: GZ8MTXP01BWCPP.44.10.A10.1.454.CMB.2.raw
  modified_base (243)..(243): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagaatatggcncgactactagcctggtaccagcagagacctggccagcctcccaggcctcctcactcccacggtgcactcccaaacgcggccacgtcggccgtcccccctggacaggttccaggtcgggctgggtcgggtcgtggggactaggtactttcgactctcacatcagcacgcctggacgctagaagtatttgtgattgtattactgtctagttcattcggttcccttacctcgtaactttcggaccgttaggggtaaccttaaacgtacggtaaattaccgttaaaacgaacgttcggtggtaacttcggaccacctaagttcttaacg

SEQ ID NO: 376759 - DNA, 601 bp, Homo sapiens
  misc_feature: GZ8MTXP01A4YN9.44.10.A10.1.454.CMB.2.raw
  modified_base (310)..(310): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggccaccctgtctttgtctgcaggggatagagcctcctctcctgcagggccagtcagaatattggcgccgactacttagcctggtaccagcagacgacctggccagcctcccaggctcctcactccacggtncactcccaacgagggccacgtggccgtcccccctggactggttccaggtcggctggtgggtctggggacagtacttcactctcaccatcagcagcctggacgcctagaagtattttggaggtattggttattacgtgttctacttttccagttcggttacccctttaccgttacgttaaccgttttcggacccgttacgggggtaacccttaaacgttagggtaaaacttaccgaaaacggttaaccgttaaggtacggtccgttaggacccttacctaacgttccgtttg

SEQ ID NO: 376760 - DNA, 658 bp, Homo sapiens
  misc_feature: GZ8MTXP01BL1X3.44.10.A10.1.454.CMB.2.raw
  modified_base (191)..(191): a, c, t, g, unknown or other
  modified_base (223)..(223): a, c, t, g, unknown or other
tcagacagtatatacacgaccggtgctcgatttagcgtcgatctcagggggggcacaagaggcagcactcaggacaatctccagcatggcctggtctcctctcctcctcactctcctcgctcactgcacagggtcctgggcccagtctgtgctgacgcagccgccctcaggtgtccgtggggcccccgggnaggacgggtcaccatctcctgcacgtggggancagctcaatagtcgggcagtattatgatgtgcacgtggtaccagactaacttccgaaggaacaccgacccccaaactcctacatctaatacggtaaacaacaactccgacccctacgacggggtccctagacccccgtattctctcgtccctaaccgtaagtcgtcgcctaccgttcacgtcccctccgtcgccctatccgacgtcgggcctcccgacgtccgtaggacggacgtgggaacgggtacgtaatttacgttaacgtcggtaccgtaggtaccgtacggaaaggtaggtacggttcggggacgggtaacgggtaactaacggtcgttacggacccggttaccgttaacgggtccaaccggaccccgaacgggcccttcccggcccccgttcggtaccctcccgttcccgttcccgttcccccgtcccc

SEQ ID NO: 376761 - DNA, 571 bp, Homo sapiens
  misc_feature: GZ8MTXP01EJ2F7.44.10.A10.1.454.CMB.2.raw
  modified_base (244)..(244): a, c, t, g, unknown or other
  modified_base (307)..(307): a, c, t, g, unknown or other
  modified_base (431)..(431): a, c, t, g, unknown or other
  modified_base (445)..(445): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcncgactacttagcctggaccagcagagacctggccagccctccaggcctcctcactccacggtncactcccaacgcgggcccacgtcggccgttccccccctggactagggttccaggttcgggacctaaggggtcggggtctgggggaacaggtacctttcactctcaccatcagcacgcctggacncctgaagtatttgnggtattgttattacgtgtctatttcagttcgtcccttacttcgtaacgtttcggaccgttaggggaaaccttaaacgtaggtaaacttacgaaacgacgtgtcggctgacactaagttcgttaacg

SEQ ID NO: 376762 - DNA, 529 bp, Homo sapiens
  misc_feature: GZ8MTXP01BZJRP.44.10.A10.1.454.CMB.2.raw
  modified_base (308)..(308): a, c, t, g, unknown or other
  modified_base (354)..(354): a, c, t, g, unknown or other
  modified_base (415)..(415): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagaatattggcgccgactacttagcctggtaccagcagagacctggccagcctcccaggcctcctcatccacggtncatcccaacagggcccactggcctccccctgacaggttcaggtgcnggtgggctggggacagcttcactctcaccatcagcacgcctggacgcctgaagtattttgnggtattgtattactgtctatttccatcggtcccttactcgtaactttggccttaggggaccaaacgtggaaacttacgaaacgttactggtcggcttggcacctaagttcttcg

SEQ ID NO: 376763 - DNA, 640 bp, Homo sapiens
  misc_feature: GZ8MTXP01BFBM2.44.10.A10.1.454.CMB.2.raw
  modified_base (167)..(167): a, c, t, g, unknown or other
  modified_base (187)..(187): a, c, t, g, unknown or other
  modified_base (217)..(217): a, c, t, g, unknown or other
  modified_base (418)..(418): a, c, t, g, unknown or other
  modified_base (434)..(434): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctnagtgtcgtggggccccgggnaggagggtcaccatctcctgcacgtgggancagctccaatgtcgggcagtattatgatgtgcactggtaccagcaacttccaaggaacacgaccccccaaatccctacactctaatacggtaaaccaaccgaaattccggacccccttacgaacgggggtcccctaggacccccgtatttctctcgccctaccaagtctcggctacttcacgtccctccgtgccatcacgngggcctcagcctgagngtgaggcgtattacgtactgccagtcgtcgaagtacgtacggttcgggcgggtaagggtacctaaaggtccgtaaggaccccggttccgttacggggttacccaacgggttacccccgttaaagggttccccgttcccgggtcccccccggtttaacggggtccctaacccgtttccccggttcccggttttccccccggtccccc

SEQ ID NO: 376764 - DNA, 635 bp, Homo sapiens
  misc_feature: GZ8MTXP01CP2EH.44.10.A10.1.454.CMB.2.raw
  modified_base (237)..(237): a, c, t, g, unknown or other
  modified_base (242)..(242): a, c, t, g, unknown or other
  modified_base (309)..(309): a, c, t, g, unknown or other
  modified_base (390)..(390): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtcttgctgcaggggatagagccctcctctcctgcagggccagtcagaatntggcncgatactagcctggtacagcagagacctggcccaggccctcccgaggcctcctcactcccgacggtnccatcccgaacgacgggcccacgtcggacctcccccctaggactaggttccaggtcggcctaagggtgggtcctggggacncggtacttcactctcaccatcagcacgcctggacgccgttagaagttcgtttggtacggtagttaggttaactttacgttacgttactacgttttacctaacgtttccggttacccctttaccgtaccgtttaaacgttttcgggacccgttaacgggggaaacccttaaacggtacggtaaacttaaccgaaacgttacgttaaggtacggtaacctactaccgttacttcgttcgtttaaccg

SEQ ID NO: 376765 - DNA, 655 bp, Homo sapiens
  misc_feature: GZ8MTXP01C0JS9.44.10.A10.1.454.CMB.2.raw
  modified_base (312)..(312): a, c, t, g, unknown or other
tcagacagtatatacacgaccggtgctcgatttagcgtcgatctcaggggagagctctggagaagagctgctcagttaggacccagagggaaccatcggaaaccccagcgcagcttctcttcctcctgctactctggctccagataacaccggacaacctgtgttgacgcagtctccaggcacctgtcttgtctgcgaggggatagacgcctcctctcctgcagggccagtcagaatagttggcgccgactacttagcctggtaccagcagagacctggccagcctcccaggcctcctcactcccacggtcncactcccgaacgacgggccacgtcggccgtcccccctaggactggttaccgaggttcgggacgtgggttggggtccgtagggggaacctaaggttacggtttactcgttacaaccgatcctaccgaggaccctaaggcgtacctagtaagttattttcgactttaagttttaattaccgttggttaccaacggtccttaccggaacaaaggtaaacggttcggtacccttacctaaattacgttcctaaccgtttccgggacccgttacggggtaaacctaaagggttcgttaacttacgtaaccgaaaacgtaacgttggtcgggttacgtcgaactaaccg

SEQ ID NO: 376766 - DNA, 570 bp, Homo sapiens
  misc_feature: GZ8MTXP01E3YMP.44.10.A10.1.454.CMB.2.raw
  modified_base (242)..(242): a, c, t, g, unknown or other
  modified_base (295)..(295): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtcttgtctgcaggggatagagcctcctctcctgcagggccagtcagaatatggcncgactacttagcctggtaccagcagagacctggccagcctcccaggcctcctnactcccacggtgcatccaacgagggccacgtcgggcctccccctggactaggttccagtcgggcaaggtgggtctggggacaggtacttcactctcaccatcagcacgcctggacgccgtagaagtatttgtgtagttgtattactgttctactttcattcgtcccttacctcgtaactttcggaccgttaacggggaaaccttaaacgtagggtaaaacttacgaaaaacgttacgtaaggtacgggtcctacggaccaacctaagttcgttcg

SEQ ID NO: 376767 - DNA, 583 bp, Homo sapiens
  misc_feature: GZ8MTXP01C9GS1.44.10.A10.1.454.CMB.2.raw
  modified_base (247)..(247): a, c, t, g, unknown or other
  modified_base (312)..(312): a, c, t, g, unknown or other
  modified_base (323)..(323): a, c, t, g, unknown or other
  modified_base (341)..(341): a, c, t, g, unknown or other
  modified_base (345)..(345): a, c, t, g, unknown or other
  modified_base (354)..(354): a, c, t, g, unknown or other
  modified_base (367)..(367): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagccctccctctcctgcagggccagtcagaatattgggcnccgactacttagcctggtaccagcagagacctggccacgcctcccaggctcctcactccacggtncactccaacgnggccacgtggcctccccngacngtcagtgcngtgggctgggacngacttcactctcacatcagcagctggacgtcctagaagtagttttagtaggtagttgttaatttacgttgttacttactttacctaacgttcggttcccctttaccgttacgttaaccgttttcggaccgttaacgggggtaaccttaaacgtaaggtaaacttaacgaaacgttaaccgttaaggtcgtctacggccttactaacgttcgtttcg

SEQ ID NO: 376768 - DNA, 782 bp, Homo sapiens
  misc_feature: GZ8MTXP01EK9NQ.44.10.A10.1.454.CMB.2.raw
  modified_base (168)..(168): a, c, t, g, unknown or other
  modified_base (188)..(188): a, c, t, g, unknown or other
  modified_base (217)..(217): a, c, t, g, unknown or other
tcagacagtatatacacgaccggtgctcgatttagcgtcgatctcagggggggcacaagaggcagcactcaggacaatctccagcatggcctggtctcctctcctcctcactctcctcgctcactgcacagggtcctgggcccagtctgtgctgacgcagccgccctnagtgtcgtggggccccgggnaggagggtcaccatctcctgcactgggancagctccaatatcgggccagattatgatgtgcacgtggtacccagcaaacttccaaggaaccacgaccccccaaatcctacactctaatcggtaaaacaactaactccgacccctgaacgggggtcccctaggaaccccccgtatttcctcgtcgcccttaaacccgaaagttcctacgggaccctaaccgtttccgaaccgtccccttccccgttacgggacccctaaagttcccgtaaccggttcggggccccttacccgaacgggttccccgttagggaaccgggtacttagggaacgggtacccgggttaaattttaaccggtttaaccgttcggtaccccgtaaggttccggttaaccggaaaaggtacgggttaacgggtttccggggaacgggggtaacggggtaaccttaaagggccgttaaccgggttaaccccggttaccggttaaacggggttcccaaacgggttccccggttaaacggttccccgtttcccgggacccccccgtttcgggtacccaaccgtttccgttccccggtttaacccccgtaaccccc

SEQ ID NO: 376769 - DNA, 725 bp, Homo sapiens
  misc_feature: GZ8MTXP01CQA8P.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagaatatggcgccgactacttagcctggtaccagcagagacctggccagcctcccaggcctcctcactccacggtgcactcccaaacgacggggcccacgtcggccgtcccccctggacagggtttccaggttcgggcctaagggttcggggtaccgtgggggaaccaggtaacctttcaaccttcctaccaacccctattaccgaacggccaacggtccccgttaggggacgtccccgttagggtaaacgttaagtttttttgggaggggttaacgtttagggttttaaactttaaccgttggttaccttaactttttcccgtaaacgtttcccgggtttacccctttaaccgttaccggtttaaaccgtttttcggggaacccgttaacgggggtaaacccttaaaacggttaacgggtaaaacttaccgaaaaaccgttacgttaaggtacgggtaacttacggaccttaaccgtaacttccgtttaacg

SEQ ID NO: 376770 - DNA, 579 bp, Homo sapiens
  misc_feature: GZ8MTXP01BH5PP.44.10.A10.1.454.CMB.2.raw
  modified_base (238)..(238): a, c, t, g, unknown or other
  modified_base (244)..(244): a, c, t, g, unknown or other
  modified_base (261)..(261): a, c, t, g, unknown or other
  modified_base (306)..(306): a, c, t, g, unknown or other
  modified_base (318)..(318): a, c, t, g, unknown or other
  modified_base (359)..(359): a, c, t, g, unknown or other
  modified_base (424)..(424): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagaatnttggcncgactactagctgaccngcagagacctggccagcctcccaggcctcctcactccgacggtcncactccaaacgngggcccacgtcggccgtccccctggacgaggttcaggtgcnggtgggtctgggacagacttcactctcaccatcagcagccgtggacgcctagaagtagttttagngtaagttgttattacgtgttctatttctacgttcggttacccttaccgttccgttaacgttttcgggaccgttaagggggtaacccttaaacgtacggtaaacttacgaaacgttacgtcggtagggtctacggtccttacctaacgttcgttcg

SEQ ID NO: 376771 - DNA, 686 bp, Homo sapiens
  misc_feature: GZ8MTXP01AZC4H.44.10.A10.1.454.CMB.2.raw
  modified_base (274)..(274): a, c, t, g, unknown or other
  modified_base (315)..(315): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagacgccctcctctcctgcagggccagtcagaatagtggcgccgactacttagcctggtaccagcaganacctggccagccctcccgaggcctcctcactcccgaggtcnccactcccaaacgtcgggcccacgtcggcctccccccgtagacgtaggttcaggttcgggccgtaagggttcggggtaccgtaggggacctaggtacctttccgaaccttccctaccgaaccctagttaccgacgccgaacggcccgttacgggaacgtcccgttaggtaaagttagttttttggtaggttagttacggtttaactttaacgttcggtttacctaacttttccgtagttccggttacccctttacgttaccggttaacgttttcgggacccggttaagggggtaaacccttaaacggttaacggtaaacttaccgaaaacgttacgttggtacgcgttacggccttaccgtaattcgttcg

SEQ ID NO: 376772 - DNA, 732 bp, Homo sapiens
  misc_feature: GZ8MTXP01CX34K.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcaagaatattggcaccgactacttagctggtaccagcagagacctggccacgcctccaggcctcctcactccacggtgctaactacccaaacgacgggcccaacgtcggcccgttacccccctaggaactaggtttccaaggttcgggaccgtaagggtcggggtaccgtagggggaacctaggtaccctttcaaaccttccttaccaaccctaactaccgaacgtaccgaacggtcccgttacgggaaccggtacccgttaggaaaacggttaacgttttttgggttacggggttaaatttacggttttaaatttaacgttacgtttaccgttaactttttaccgtaaacgtttccgggttacccctttaaccgttaccggttaaccgttttaacgggaccggttaacggggtaaacccttaaacgtaaacggtaaacttaacgaaaacgttaaccgttaaggtacggtccgttacggacccttacctaacgttcgttcg

SEQ ID NO: 376773 - DNA, 599 bp, Homo sapiens
  misc_feature: GZ8MTXP01DDJ0D.44.10.A10.1.454.CMB.2.raw
  modified_base (242)..(242): a, c, t, g, unknown or other
  modified_base (362)..(362): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcacctgtctttgtctgcaggggatagagcctcctctcctgcagggcagtcagaatattggcnccgactacttagcctggtaccagcagacgacctggccagcctccgaggctcctcactcccacggtgcactccaacgacgggccacgtcggccgtcccccctggactaggttcagtgggcnggtgggtctggggacagacttcactctcacatcagcagccgtggacgcctagaagttatttgtaggtagttgttaactttacgtgtacttactttacctaagttcggttcccctttaacctcgttaaaccgttttgggacccgttaacgggggtaaacccaaacggttaacgggaaaacttaccgaaaacgttaacgtcggttagggcttacggaccacctaacttccggtttaacg

SEQ ID NO: 376774 - DNA, 748 bp, Homo sapiens
  misc_feature: GZ8MTXP01DTLMJ.44.10.A10.1.454.CMB.2.raw
  modified_base (244)..(244): a, c, t, g, unknown or other
  modified_base (309)..(309): a, c, t, g, unknown or other
  modified_base (321)..(321): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctccagataacaccggacaacctgtgttgacgcagtctccaggcaccctgtctttgtctgcgaggggatagagccctcctctcctgcagggccagtcagaatatggcnccgactactagcctggtaccagcagagacctggccagccctcccaggcctcctcactcccaggtncactccaaacgngggcccacgtcggaccgttccccccaggaacgtacgggtttcaacggggttcgggaccgtaaggggttcggggtacctagggggaaacctaagggttaaccctttccgaaacccttccttacccgaaacccctaagttaccaacggaccgaaacggtcccgttagggacgtacccgttaagtaaacggttagtttttcggtaggggttaatttacggtttaaactttaaccgttgttaccttacttttaccgttaaacgttccgggtttacccctttaaaccgttccgttaaaaccggttttcgggaaaccccgttaaacgggggtaaacccttaaaaaccggtaagggtaaaacttaaaccggttaaaacgttaaccgttaagggttacggaacttacggacccttaaccgtaacttcgtttaacg

SEQ ID NO: 376775 - DNA, 837 bp, Homo sapiens
  misc_feature: GZ8MTXP01A24DN.44.10.A10.1.454.CMB.2.raw
  modified_base (239)..(239): a, c, t, g, unknown or other
  modified_base (244)..(244): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatntggcncgatactagctggtaccagcagagacctggccacgccctcccaggcctccctcactcccgacggtcgacctactacccaaacgacgggcccacgtcgggccgtcccccctaggaaccgtaggggtttccaagggttcgggacctaagggggtttcggggggtcccgttacgggggggaaaccctaacggggttaaacccgttttcccgaaacccgtttccccgttacccgtaaaccccgaaacttacccggaaacgggtcccgaaaccgggtccccgtttacgggggaaaccggtccccggtttaagggaaaacggtttacgtttttttaggggtacggggtttaaagtttagttttaaacgttttaccgtttacggtttaccttaacgttttttaccctaacgtttcccggggtttaccccccttttaaccgttaccccggtttaaacccggtttttaacgggaaccccggttaaacggggggtaaaccccttaaaacgggttaaccgggtaaaaacttaacccgttaaaaacggttaaccgtttaacggtacggtcttacggaccttaacccgtaacgttccgtttaaccg

SEQ ID NO: 376776 - DNA, 743 bp, Homo sapiens
  misc_feature: GZ8MTXP01CYFYF.44.10.A10.1.454.CMB.2.raw
  modified_base (309)..(309): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctccagataacaccggacaacctgtgttgacgcagtctccaggcacctgtctttgctgcgaggggatagagcctcctctcctgcagggccagtcagaatattggcgccgatacttagcctggtaccagcagagacctggccagcctcccgaggcctcctcactcccgacggtnccaactccgaaacgacggggcccacgtcgggccttccccccgtaggaacgtagggtttccaagggttcgggccgtaaggggttcggggtaccgtagggggaaacctagggtaaccctttccgaaccttcctaccaacccaactacaacgaccgaacgtcccgtagggacgtcccgttaaggtaaagttagtttttaggtaggttaacgtttaggtttaaactttacgttacgttaccttaacgtttttaccctaacgtttccggtttacccctttaacccgttaccggtttaaaaccggtttttccgggaaacccgggttaaacgggggtaaacccttaaaacggttaacgggtaaaacttaaccgttaaaaaccgttaacgtttaacgggtaacgggtccttacggaccttaaccgttaacgttccgtttccg

SEQ ID NO: 376777 - DNA, 641 bp, Homo sapiens
  misc_feature: GZ8MTXP01EPI0N.44.10.A10.1.454.CMB.2.raw
  modified_base (246)..(246): a, c, t, g, unknown or other
  modified_base (311)..(311): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggccaccctgttctttgtctgcgaggggatagacgcctcctctcctgcagggccagtcagatatggcncgactactagctggacagcagacgacctggccacgccctcccaggcctcctcactcccgacggtnccactccaaacgcgggcccacgtcgggccttccccccgtaggacgtaggtttccaggttcgggcgtaagggttcgggtcgtacggggactaggtacccttacaccttcctaccacctactacgagcaacgccgtaggacgccgtagtaacgttagttttgtacgggtatttaggttaactttacgttgtacttacgtttaccgtacgtttcccggttccctttaacgttacgttaacgttttcggaccggttaacgggtaaaccttaaagtacggtaaacttaacgttaaacgttacgtggtcggtctcgacttaaccttcgttcgttcg

SEQ ID NO: 376778 - DNA, 583 bp, Homo sapiens
  misc_feature: GZ8MTXP01D3CBD.44.10.A10.1.454.CMB.2.raw
  modified_base (241)..(241): a, c, t, g, unknown or other
  modified_base (246)..(246): a, c, t, g, unknown or other
tcagacagtatatacacgaccggtgctcgatttagcgtcgatctcagggggagagctctggagaagagctgctcagttaggacccagagggaaccatggaaaccccagcgcagcttctcttcctcctgctactctggctccagataacaccggacaacctgtgttgacgcagtctccaggcaccctgtctttgtctggcgaggggatagacgcctcctctcctgcagggccagtcagaatntggcnccgatactagcctggtaccagcagacgacctggccacgccctccgaggcctcctcactcccgaggtcacactacccaaacgcgggccacgtcggcctccccctggactaggttccaggtcggactgggtcgggtactggggacaggtcttcactctacacatcacgcacgcctaggacgccgtagaagttatttgtagtattgttattactgtctattctagttcgtacccttacgtcgtaacgtttcggccgttaaggggtaaccttaaacgtagggtaaacttacgttaaaacgttaacgtggtacggctcgaccttacctaacgttcgttaacg

SEQ ID NO: 376779 - DNA, 711 bp, Homo sapiens
  misc_feature: GZ8MTXP01ATQY9.44.10.A10.1.454.CMB.2.raw
  modified_base (245)..(245): a, c, t, g, unknown or other
  modified_base (314)..(314): a, c, t, g, unknown or other
  modified_base (353)..(353): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagacgccctcctctcctgcagggccagtcagaatatggcnccgactacttagcctggtaccagcagagacctggccagccctcccgaggtcctcctcactccgacggtncatcccaaagcgggccacgtcggcctacccccctgacgngggtttccaggttcgggcctaagggttcggggtctacgggggactagggtacctttcaacctcctaccgaaccctaacgtacgacgtaccgtacggtccggtacgggaccgtaccgttaggttaaacgttagttttacggtagggttacgtttacgtttaacgtttaccgtttacgttaccgttacgttttacccgtacgtttcccggtttaccccttaccgtttaccgttaacgtttccgggaaccggttaaaccggggtaaaccttaaaccggtaaacggtaaaaccgttaaccgttaaaccggttacgtaacggtcgtaaccgtacgtaccgttaccgttaacgttccgttaacg

SEQ ID NO: 376780 - DNA, 639 bp, Homo sapiens
  misc_feature: GZ8MTXP01C1WU2.44.10.A10.1.454.CMB.2.raw
  modified_base (318)..(318): a, c, t, g, unknown or other
tcagacagtatatacacgaccggtgctcgatttagcgtcgatctcaggggagagctctggagaagagctgctcagttaggacccagagggaaccatggaaaccccagcgcagcttctccttcctcctgctactctggctcccagataacaccggacaacctgtgttgacgcagtctccaggccaccctgtctttgtctgcaggggatagagccctccctctcctgcgagggccagtcagaatattggccgccgactacttagcctggtaccagcagacgacctggccacgcctcccaggcctcctcactcccacggtncactccaacgacgggcccacgtggaccgtccccctggactggttccagggtcggccgtaaggggttcgggtacgtcgggggaactacggtaacctttcaaacccttcctacctacccatccgacgacgacgtccgtaggacgaccgtagtaagttagttttgtagggttattagtttaagttacttgttactactttccgtaacgttccgttccctttaccttccgttaaccgttttcggaccgttacggggtaaaccttaaacgtaacggaacttaacgaaacgttacgtggtacggctcgaccttactaacgttcttcg

SEQ ID NO: 376781 - DNA, 612 bp, Homo sapiens
  misc_feature: GZ8MTXP01CBQWA.44.10.A10.1.454.CMB.2.raw
  modified_base (327)..(327): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggccaccctgttctttgtctgcgaggggatagacgcctccctctcctgcgagggccagtcaagtaatagttcgggccgccgtactacttacgcctggtaccagacaagaaaccgtggaccagacctccaggcctcctcatctagtggtncatccgagcgaggcctgcggaccacgtccggatggtcaaggtggcgagggttcgggtcgtaggggactagtaccttctaccttctccacatacgacgccgaagccgtagggacgaccgtagtaagttatttttacgggacgttaggttacgttagtttacgtcgtcgagtactagttatacgttcttaactctaccgttcgtaccggttacgttaccgggacgaaacgggttaccgttaaagggtaacgaaagttaacgaaacgtacgttaggtcgttcgtaacg

SEQ ID NO: 376782 - DNA, 594 bp, Homo sapiens
  misc_feature: GZ8MTXP01CDFMQ.44.10.A10.1.454.CMB.2.raw
  modified_base (220)..(220): a, c, t, g, unknown or other
  modified_base (315)..(315): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggcctcccagataacaccggacaacctgtgttgacgcagtctccaggcaccctgtctttgtctgcgaggggatagacgcctccctntcctgcagggccagtcagaatatggcgccgatacttagcctggtaccagcagagacctggccagcctcccgaggcctcctcactccgaacgggtnccactccaaacgagggcccacgtggccgtccccctggacaggttccaggtcggctgggtgggtaccgtggggactaggtaccttcacctactcaccctatcaagcagcctgggacgtccgtagaacgttatttgtagggattgttaattacgttgtactactttaccgtacgttccgttacccttacgtacgttacgtttcgggaacgttaacgggtaaaccttaaacgtaacggtaaacttacgaaacgttacgtgacgctcgacactaagttcgttg

SEQ ID NO: 376783 - DNA, 613 bp, Homo sapiens
  misc_feature: GZ8MTXP01E1UQT.44.10.A10.1.454.CMB.2.raw
  modified_base (246)..(246): a, c, t, g, unknown or other
  modified_base (325)..(325): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagacgccctcctctcctgcagggccagtcagaatattggcnccgatacttagcctggtaccagcagacgacctggccacgcctcccaggcctcctcactccacggtgcactacccaacgngggccacgtcggcctacccccctaaacgacgggtttcaggtcggacgtagggttcggggtcgtaggggacacggtacctttcgacttcctacacccacgtacacggaccacgcctgggacgtccgtagaagttatttggtagtacgttgttattacgtcgttctactttccagttccgttcccttaccgttcgtaacgttttcggaaccgtaacggggttaacctaaacgttaggaaacttacgaaaacgttacgttcggtgcgtcgacaccttacgttcttcgttcc

SEQ ID NO: 376784 - DNA, 719 bp, Homo sapiens
  misc_feature: GZ8MTXP01BS6WE.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggccaccctgtctttgtctgcgaggggatagacgccctccctctcctgcgagggccagtcagtaatattggcgccgactacttagcctggtaccagcagacgacctggccacgccctcccgaggcctccgtcactccccgacggtgccactacccgaaacgcgggaccacgtcggcctccccctgacgtaggttccaggtcgggctgggtcgggtacgtggggactaggtaccttcgaccttacctccaacctacgtacgacgacaacggtccgtacgggacgaccgttagtaaagttagttttaggtaggttaagtttacggtttaactttacgtttacgttacttacttttaccgtaacgtttcccggtttaccccgtttaacccgtttaccggttaacccgtttttaacggggaacccgttaaaccgggggtaaaccttaaaaccggtaacggtaaaacgttaacccgttaaaacggttaaacggttaacggtacgggtaaccttacggacccttaacctaacgtttaaccgtttccg

SEQ ID NO: 376785 - DNA, 664 bp, Homo sapiens
  misc_feature: GZ8MTXP01CAU8W.44.10.A10.1.454.CMB.2.raw
  modified_base (189)..(189): a, c, t, g, unknown or other
  modified_base (218)..(218): a, c, t, g, unknown or other
  modified_base (243)..(243): a, c, t, g, unknown or other
  modified_base (249)..(249): a, c, t, g, unknown or other
  modified_base (283)..(283): a, c, t, g, unknown or other
tcagacagtatatacacgaccggtgctcgatttagcgtcgatctcagggggggcacaagaggcagcactcaggacaatctccagcatggcctggtctcctctcctcctcactctcctcgctcactgcacagggtcctgggcccagtctgtgctgacgcagccgccctcagtgtcgtcggggccccgggnagaggtcaccatctcctgcacgtgggacncagctacaatcgcggacagtatagngatgcncacgtcgtaccagactaaccgtcgaacggaaccncccgaaccccctaaatcctacacttacgtaagtacgtaaacaactacgtcccgtaccccgtaggacggtccctacgtaccccgtcttcgtcgtccgtccctaactagtcgtcgtacctacgttccgaccgtccccgtcgacgacctacgtaccgtacggtcgggtccgttaccgggtacggtacggtcgtacggacgttcgttacgttacgtttacgtttcggggttcggtcgggtcggttacggttaggtactcggtaccgttacgttcgtaggtcggttacggtcgtcggtacgttacgggtcgggaccgggtaacgtaccgttacgttccgttacgtaaccgtacgtaacgcgacgaccgtaacggttccgtccccgg

SEQ ID NO: 376786 - DNA, 563 bp, Homo sapiens
  misc_feature: GZ8MTXP01E255A.44.10.A10.1.454.CMB.2.raw
  modified_base (168)..(168): a, c, t, g, unknown or other
  modified_base (189)..(189): a, c, t, g, unknown or other
  modified_base (217)..(217): a, c, t, g, unknown or other
  modified_base (242)..(242): a, c, t, g, unknown or other
  modified_base (286)..(286): a, c, t, g, unknown or other
  modified_base (301)..(301): a, c, t, g, unknown or other
  modified_base (385)..(385): a, c, t, g, unknown or other
  modified_base (477)..(477): a, c, t, g, unknown or other
tcagacagtatatacacgaccggtgctcgatttagcgtcgatctcagggggggcacaagaggcagcactcaggacaatctccagcatggcctggtctcctctcctcctcactctcctcgctcactgcacagggtcctgggcccagtctgtgctgacgcagccgccctnagtgtcgtggggcccccgggnaggaggtcaccatctcctgcactgggancagctccaatagtcgggcagattangatgtgcactggaccagcaactccagaacacgcccccaaatccnatctatgaacaactntccggccctgtacggggtccctagaccccgtattctgtcggctaacccgaagtcgtcggccaccttccgacgtccccttcccgnggccctacgtccacgtcgggcctccgaggcctagaagagtggagggtagtattagttactcggcctacgtcctatcgacaggcacgcctcgnggttgggttgggttcggttacgggcgggacgggaccgaacgcgttcgaaccggtccgtcgggtcgacgcccgaaggccgtccccgg

SEQ ID NO: 376787 - DNA, 729 bp, Homo sapiens
  misc_feature: GZ8MTXP01BRCK8.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctccagataacaccggacaacctgtgttgacgcagtctccaggcactctgtctttgtctgcgaggggatagacgtccctccctctcctgcgagggccagtcaagtaatagtcggcgcgtactacttagcctaggaccagcagacgacctggcccacgcccctacccgaggtccctcctcactcccgacgggtcacccacgtaccgaaacggcgggcccacgtcggcccccgtcccgtaggaccgtaggttcgaagggttcgggcgtaggggttcggggtacgtacggggaacctacgggtacttaccgaccttcctaccgaacctacgtaccgaacgaccgtaacgtcccgtaggggaccgtaccgttaaggtaaacgtttagttttggggtagttaagtttacgttaactttacgttcgttacttacttttaccgacgtttacccggttaccctttaccgttaccggtttaaaccgttttcgggaacccggtaaacggggttaaacctaaaacggttaacgttaaaacgttaaccgttaaaaccggtaacgttacggtaacgtacgtacggacctaaccgttaacgtttccg

SEQ ID NO: 376788 - DNA, 754 bp, Homo sapiens
  misc_feature: GZ8MTXP01DPD2R.44.10.A10.1.454.CMB.2.raw
tcagacagtatatacacgaccggtgctcgatttagcgtcgatctcagggggagagctctggagaagagctgctcagttaggacccagagggaaccatggaaaccccagcgcagcttctcttcctcctgctactctggcctcccagataacaccggacaacctgtgttgacgcagtctccaggcaccctgtctttgctgcgaggggatagcgcctccctctcctgcgagggccagtcaagaattagtggccgccgaactacttagcctggtaccagcagacgaccgtggcccacgccctcccgaggtccctccgtacactcccgacggtgacctactacccgaaacgcgggcccacgtcggcccgtcccccgtaggaactaggggttccaagggtcgggacctaaggggtcggggttaccgtacgggggaaccacgggtacctttccgacccttcctaccaaccgtactaccgagacccgaacggtccccgttaggggaacgtacccgttaagggaaacgtttagttttttacgggagggttaacgtttaggttttaactttaaccgttcggttaacctttaccttttacccgtaacgtttcccgggtttaaccccctttaacccgtttaccggtttaaccgttttccgggaacccgttaaacgggggtaaaccccttaaaaggtaacggtaaaacttaccggttaaaacgttaccggttggtacggtctcggaccttacctaattccgttaacg

SEQ ID NO: 376789 - DNA, 650 bp, Homo sapiens
  misc_feature: GZ8MTXP01CGHGP.44.10.A10.1.454.CMB.2.raw
  modified_base (219)..(219): a, c, t, g, unknown or other
  modified_base (503)..(503): a, c, t, g, unknown or other
tcagacagtatatacacgaccggtgctcgatttagcgtcgatctcagggggggcacaagaggcagcactcaggacaatctccagcatggcctggtctcctctcctcctcactctcctcgctcactgcacagggtcctgggcccagtctgtgctgacgcagccgccctcagtgtcgtcggggccccgggcaggaggtcaccgatctcctgcacgtgggancagctaccaatagtcgggccagtattagtgatgtgacacgtcggtaccagcaacgttccaacggtaaccacgaaccccctaaactccgtactacttcgtttaacggtaacaacttacgtccggaccctacgacggggttccctcgtaccgtacttccgtcgtcggacctacccgtaaagttccgtcggtaccctaccctacgacgcccccttcccgtcggaccctacgtcctacggtcgggcctccgaggtctacgaagtagtggagggtctagttacttacgngtaccgtagtacccgtagtagcgtagaccagtccgtacgtagggttcgggttaagggttcggttcgggaccgggttaggaaccgtacgcgttcgacccggttcggtacggtccgacgacccggttaccgtcgttcccggtcccccgg

SEQ ID NO: 376790 - DNA, 710 bp, Homo sapiens
  misc_feature: GZ8MTXP01AG9CH.44.10.A10.1.454.CMB.2.raw
  modified_base (169)..(169): a, c, t, g, unknown or other
  modified_base (191)..(191): a, c, t, g, unknown or other
  modified_base (220)..(220): a, c, t, g, unknown or other
tcagacagtatatacacgaccggtgctcgatttagcgtcgatctcagggggggcacaagaggcagcactcaggacaatctccagcatggcctggtctcctctcctcctcactctcctcgctcactgcacagggtcctgggcccagtctgtgctgacgcagcccgccctnagtgtcgtgggggcccccgggnaggcggtcaccatctcctgcacgtgggancagctcaatcgtcgggacagtattagtgatgtgctactcggtaccagactacctaccgaacggaaccacccgaccccctaaactcctacactactagtacggtaacaactacgtccgaccccgtacgaccggggtcccgtcgtaccccgttacttcgtccgtaccgtccctaaacccgtaacgttccgtccggccttaccgttaccgaccgtccccttcccgtaccgggacctaacgttcccgaccggttcggggtcccgttcccgggtaccggtaaggacgtcggtacgggttctagttacgttttactttcgggggttggtcgggtcgggttacgttaggggtatacggtacgtacttccgggttaggtacggttacggtacgtggtccggttacggtccgggaggtaaccggtacgttacggttccgttaccggtaacccgtaccggttaacggtcgacccggacccgtaacggttccccgtcccgg

SEQ ID NO: 376791 - DNA, 521 bp, Homo sapiens
  misc_feature: GZ8MTXP02JK9AP.44.10.A10.1.454.CMB.2.raw
  modified_base (318)..(318): a, c, t, g, unknown or other
  modified_base (353)..(353): a, c, t, g, unknown or other
tcagacagtatatacacgaccggtgctcgatttagcgtcgatctcagggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgcgactacttagcctggtaccagcagagacctggccagccctcccaggcctcctcatcccacggtgcatccaacncgggccactggctccccctgacaggttcagtggcngtgggtctggggacagacttcactctcaccatcagcagcctggacgcctagaagtatttgtgattgtattactgtctatttccatcggtcccttactcgtaactttcggccaggggtaccaaacgtggaaactacaaacgtactgtacggctacgcacctatcttacg

SEQ ID NO: 376792 - DNA, 607 bp, Homo sapiens
  misc_feature: GZ8MTXP02HXVVN.44.10.A10.1.454.CMB.2.raw
  modified_base (244)..(244): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcnccgactacttagcctggtaccagcagacgacctggccagccctcccaggcctcctcactccacggtgccatcccaaacgcgggcccacgtcggcctcccccctaggacctaggttccaggttcggcctaggggttcggggtctgggggactaggtacctttcacctcctaccacctatcagcacgcctggacgccgtagaaagtattttgtagtagttagttatttactgtctactttcctagttcggttcccttacgtacgttaacgttttcggaccgtaggggtaaccctaaacgtacggtaaactaccgaaaacgtacgtaacggtacggacgttacgaccgtaccctatttaccgttcg

SEQ ID NO: 376793 - DNA, 653 bp, Homo sapiens
  misc_feature: GZ8MTXP02I9BIS.44.10.A10.1.454.CMB.2.raw
  modified_base (313)..(313): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagagacctggccagccctcccgaggcctcctcactcccacggtnccatcccaacgacgggccacgtcggccgtccccctgacctagggttccaggttcggcctaggggttcggggtccttgggggaccaggtacctttccgaaccttcctccaacccatacgaacgccacgtcccgtagggacgtcccgtaggaacgttaagtttttggtagtatttaggttattacgttgttactatttccagttcggttacccctttaccgtaccgttaacgttttcgggacccgtaagggggtaaccctaaaacgttacgggtaaaactaccgtaaaaccgtaaccgttaaggtacggtacgttacggacctacccgtagttacctttacg

SEQ ID NO: 376794 - DNA, 602 bp, Homo sapiens
  misc_feature: GZ8MTXP02FQ7ED.44.10.A10.1.454.CMB.2.raw
  modified_base (308)..(308): a, c, t, g, unknown or other
tcagacagtatatacacgaccggtgctcgatttagcgtcgatctcaggggagagctctggagaagagctgctcagttaggacccagagggaatcatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcgccgactacttagcctggtaccagcagagacctggccagcctcccaggcctcctcatccacggtncatccaaacagggccacgtggcccgtccctgacaggttcagtgcagtggtctgggacagcttcactctcacatcagcacgcgtgacgcctgaaagtagtttgtagtattggttacttaacgtcgttactacttttccctaagttcggttacccctttacccgttaccgttaaaccgtttttacgggacccgtaaacgggggtaaacccctaaaacgttaacgggtaaaaacttaccgaaaaaccgtaaaccgttaggtacggtaccgttacggaccaacccgtacgtttacccg

SEQ ID NO: 376795 - DNA, 520 bp, Homo sapiens
  misc_feature: GZ8MTXP02JB12R.44.10.A10.1.454.CMB.2.raw
  modified_base (244)..(244): a, c, t, g, unknown or other
  modified_base (351)..(351): a, c, t, g, unknown or other
  modified_base (366)..(366): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcnccgactactagcctggtaccagcagagacctggccagcctcccaggctcctcatccacggtgcatccaacagggccacgtggcctccccctgactggttcagtggcnggtgggtctgggacngacttcactctcaccatcagcagcctggagcctagaagtattttgtgtagttgtattactgtctatttcattcgtcccttactacgtaactttcggccgtaggggaccaaacgtacggaactacaaacgactaagtgactcgacaccatcttcg

SEQ ID NO: 376796 - DNA, 605 bp, Homo sapiens
  misc_feature: GZ8MTXP02FP4WC.44.10.A10.1.454.CMB.2.raw
  modified_base (240)..(240): a, c, t, g, unknown or other
  modified_base (245)..(245): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcgaggggatagacgcctccctctcctgcagggccagtcagatntggcncgactactagctggtaccagcagagacctggccagccctccgaggcctcctcactcccgacggtgcaactcccaaacgacgggccacgtcggccgtccccctagacctaggttcaggtcggcaggtcgggtctggggacagtactttcactctcaccatcagcacgccgtaggacgtcctagaagttagttttgaggtattgttatttaacgttgttacgttactttacttacgttcgttacccgttaccgttacgttaacgtttacggtaccggtaacgggtaaaccgtaaacgtaaacgtaaacgtaaacgtaaacgtaacgtaacggtacggtacgtacgtactactactacgttcg

SEQ ID NO: 376797 - DNA, 493 bp, Homo sapiens
  misc_feature: GZ8MTXP02IO3KJ.44.10.A10.1.454.CMB.2.raw
  modified_base (185)..(185): a, c, t, g, unknown or other
  modified_base (214)..(214): a, c, t, g, unknown or other
  modified_base (319)..(319): a, c, t, g, unknown or other
  modified_base (390)..(390): a, c, t, g, unknown or other
tcagacagtatatacacgaccggtgctcgatttagcgtcgatctcagggggcacaagaggcagcactcaggacaatctccagcatggcctggtctcctctcctcctcactctcctcgctcactgcacagggtcctgggcccagtctgtgctgacgcagccgccctcagtgtctggggccccgggnaggagggtcaccatctcctgcactgggancagctccaatatcgggccagattatgatgtgcactggtaccagcaacttcaggaacacgcccccaaatcctcatctttgaacaactatcgcctcgacgggtcccngaccgatctctggctcaagtctggcacctcagccctcctggccatcactggctcagctgaagatgagggtnattattactgccagtcctatgacagcagcctcagtcggttgggtgttcgggcggtagggaccagctgaccgtcgtgggtacacggcccaggcctacgcccccg

SEQ ID NO: 376798 - DNA, 543 bp, Homo sapiens
  misc_feature: GZ8MTXP02ING8K.44.10.A10.1.454.CMB.2.raw
  modified_base (167)..(167): a, c, t, g, unknown or other
  modified_base (186)..(186): a, c, t, g, unknown or other
  modified_base (215)..(215): a, c, t, g, unknown or other
  modified_base (225)..(225): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctnagtgtctggggccccgggnaggagggtcaccatctcctgcactgggancagctcaatntcggccagattatgatgtgcactggtaccagcaactcaggaacacgccccaaatcctcatctataggtaacaacaatccgcccctgacggggtccctgaccccgattctctcgcctaccaagtccgtgctacttcacgtccctcctggccatccacgtcgggctcccgagccctgacggatcggaggcgtattattactgccaggtcgtacgaagagtacgttcgggacggagggtactaaagcgtcgaccgtcgttacggactacgacccgaagcctaaccgcccccgtcggtccaccgttctccgttcccgtcccc

SEQ ID NO: 376799 - DNA, 644 bp, Homo sapiens
  misc_feature: GZ8MTXP02HVO0D.44.10.A10.1.454.CMB.2.raw
  modified_base (417)..(417): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcagggatagagccctcctctcctgcgagggccagtcaagaatagttggcgccgactacttagcctggtaccagcagacgacctggccagccctccgaggcctcctcactcccgacggtgccatcccaaagcgggcccacgtggcctcccctagaacctggttcaggttcggctaggggtgggtctggggaccaggtaccttcacctctcacctactacancgagcccgtggacgcctagaagtattttgtgtagttgttattacttgttacttacgtttacctacgtttcggttaccctttaaccgttacgttaaaccgtttttccgggaacccggttaaacgggggtaaaccctaaaacggttaacgggtaaaacttaaccgtaaaaccggtaacgttaacgggtacgggtaccttacggacctaacccgtactttaccgtttccg

SEQ ID NO: 376800 - DNA, 591 bp, Homo sapiens
  misc_feature: GZ8MTXP02IG62H.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagagacctggccagccctcccaggctcctcactccacggtgccatcccaaacacggggcccacgtgggcctcccccctgaaccagggtttccaggttcggccaggggttcggggtactgggggaccaaggtactttcaactctcacccatcagcagccgtgacgcctagaagtagttttgtgtattagttattacgtagttctatttcctaagttcgttacccttaccgtacgtaacgttttcggaccgtacggggtaaacctaaacgtacggtaaaacttacgaaaacgacgtaagtcgacgtacgactaccattcttacg

SEQ ID NO: 376801 - DNA, 559 bp, Homo sapiens
  misc_feature: GZ8MTXP02IEERF.44.10.A10.1.454.CMB.2.raw
  modified_base (368)..(368): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagagacctggccagccctcccaggcctcctcactcccacggtcgcatcccaaacgacgggcccacgtggccgtccccctgacctaggttcaggtcggcngggtcgggtctggggacacgacttcactctcacatcagcagccgtggacgccgtagagtagtttgtgtattgttattactgtctattcattcgttccttacgtcgtaactttcggccgtacggggaacctaaacgtacggtaaactacgtaaaacgaacgtaacggtacgacgtacgacacctatcttacg

SEQ ID NO: 376802 - DNA, 510 bp, Homo sapiens
  misc_feature: GZ8MTXP02JM4B0.44.10.A10.1.454.CMB.2.raw
  modified_base (185)..(185): a, c, t, g, unknown or other
  modified_base (237)..(237): a, c, t, g, unknown or other
  modified_base (271)..(271): a, c, t, g, unknown or other
  modified_base (284)..(284): a, c, t, g, unknown or other
  modified_base (391)..(391): a, c, t, g, unknown or other
  modified_base (396)..(396): a, c, t, g, unknown or other
  modified_base (403)..(403): a, c, t, g, unknown or other
tcagacagtatatacacgaccggtgctcgatttagcgtcgatctcagggggcacaagaggcagcactcaggacaatctccagcatggcctggtctcctctcctcctcactctcctcgctcactgcacagggtcctgggcccagtctgtgctgacgcagccgccctcagtgtctggggccccgggnagaggtcaccatctcctgcactgggagcagctccaatatcgggccagattangatgtgcactggtaccagcaaacttccaggaacngcccccaaatccnatctatggtaaacaactatccggcccctgacggggtccctgacccccgtattcctctggctccgaagtcctggcacctcagccctcctgccatcactggctccagcngaagntgaggtnattatactgcagtcctaatgacagcagcctgaggtggttcgggtggttcgggcgggtacggaccgaagtcgtgaacccgtcgtcgggtcagcccgaaggtcctcccg

SEQ ID NO: 376803 - DNA, 560 bp, Homo sapiens
  misc_feature: GZ8MTXP02HA2TS.44.10.A10.1.454.CMB.2.raw
  modified_base (244)..(244): a, c, t, g, unknown or other
  modified_base (304)..(304): a, c, t, g, unknown or other
  modified_base (312)..(312): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagaatattggcnccgatactagcctggtaccagcagagacctggccagcctccaggcctcctcatccaggtncatccaancgggccacgtcggccgtccccctgacaggttccagtggctaggtgggtctggggacaggactttcactctcaccatcagcagcctggacgccgtagaagtatttgtagtattgtattacgttgtctatttctagtcgttaccttacgtcgtaacgttttcggaccgtacgggtaacctaaacgtacggtaaacttaccgaaacgtaacgtaaggtacggtacttacggacctaccgtacgtacttacg

SEQ ID NO: 376804 - DNA, 770 bp, Homo sapiens
  misc_feature: GZ8MTXP02IGERX.44.10.A10.1.454.CMB.2.raw
  modified_base (167)..(167): a, c, t, g, unknown or other
  modified_base (188)..(188): a, c, t, g, unknown or other
  modified_base (218)..(218): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctnagtgtcgtgggggccccgggnaggagggtcaccatctcctgcacgtgggancagctaccaatgtcgggcagattatgatgtgctacgtcggtaccagctaacttccgaaggaaaccaccgacccccctaaaattcccctactaactttccttttaacggaaaacctaaacctttacgtccccggtaccccttacggaaccgggggttcccctacggaacccgttactttcccgtccgtcgggtacccttaccgtaaaggttcctcggggacctaacccgttccgaaccgtcccccttcccgtgacccctacttccgaccgttcggggtccctacggaacggtcgtaggaaagtagtgggtacggggttataattttacgttaccgtcgtaccgtaacggttaccctaagtcggaaaccacggtaccgtacggtacccgttcggtacggggtttgggggttttacgggggttcgggtttaccgggggacgggtaaaccgggggtaaaccgaaacgggtccgttaccgggaacccggttcccggttcgggggtaacccaccgggacccccggtaaacgggtccccgttaccccggtaccccccgg

SEQ ID NO: 376805 - DNA, 590 bp, Homo sapiens
  misc_feature: GZ8MTXP02I7FOJ.44.10.A10.1.454.CMB.2.raw
  modified_base (307)..(307): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcgcgactactagcctggaccagcagagacctggccagccctccaggcctcctcatcccgacggtnccatccaaacgcgggccacgtggcctccccccgtagacctaggttcagtggctagggtgggtctggggacagtacttcactctcacatcagcagcctaggacgccgtagaagttatttgtagtattgttaattacgtagtacttatttacctagttcggttacccctttaccgttacgttaaacgttttcgggaccgtaacgggggtaaaccctaaaacgtacggtaaaactaaccgtaaaacgtaacgtggtacggtactacgacctacctacttcgttacg

SEQ ID NO: 376806 - DNA, 581 bp, Homo sapiens
  misc_feature: GZ8MTXP02I1VWU.44.10.A10.1.454.CMB.2.raw
  modified_base (244)..(244): a, c, t, g, unknown or other
  modified_base (310)..(310): a, c, t, g, unknown or other
  modified_base (358)..(358): a, c, t, g, unknown or other
  modified_base (374)..(374): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagatattggcncgactacttagcctggtaccagcagacgacctggccagcccctccaggcctcctcatcccacggtncactccaacgcgggccagtcggccgtcccctgacaggttcaggtcgcnggtgggtctggggacngtacttcactctcacatcagcagccctaggacgtcctagaagttactttggtcgtattgttactttacgtgttactagtttaccagtttccggttaccctttaccgtcgttaaaccgttttcggaccgtacggggtaacctaaaacgtacggtaaaactaccgaaaacgtaacgtggtcgactcggacctaacgtacgttcctttag

SEQ ID NO: 376807 - DNA, 622 bp, Homo sapiens
  misc_feature: GZ8MTXP02H56JJ.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatagttggcgccgactacttagcctggtaccagcagagacctggccagcccctcccgaggcctcctcactccgacggtgcactccaagacgggccacgtggcctccccctgaccgtaggttcaggtcggctgggtgggtctggggacagacttcactctcaccatcagcacgtccgtggacgccgtagaagttattttggtagtatttagttatttacgtgttacttagtttacctagtccggtttacccctttacgtaccgtttaaaccgttttcggacccggttaaacggggtaaccctaaaacggttacgggtaaaacttaaccgtaaaacgtaaccgttaaggtacggtaccgttacggacctaccgtactttaccgttacg

SEQ ID NO: 376808 - DNA, 603 bp, Homo sapiens
  misc_feature: GZ8MTXP02HKB43.44.10.A10.1.454.CMB.2.raw
  modified_base (309)..(309): a, c, t, g, unknown or other
  modified_base (359)..(359): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagaatattggcgccgatacttagcctggtaccagcagacgacctggccagccctcccaggctcctcatcccacggtncatcccaaacgacgggcccagtcggcgtccccctgacaggttcagtggcnggtgggtctggggacagtacttcactctcaccatcagcacgccgtggacgtcctagaagttatttgtagtagttagtatttaccgttgttactaacgttttcctaacgtttcgggttaccctttaccttacgttaaaccgtttttacgggacccgtaacgggggtaaaccctaaaacgtacggtaaaacttaccgaaaacgtaacgttaacgtacggaccttacgacctacctaattacgttcg

SEQ ID NO: 376809 - DNA, 614 bp, Homo sapiens
  misc_feature: GZ8MTXP02JFE41.44.10.A10.1.454.CMB.2.raw
  modified_base (187)..(187): a, c, t, g, unknown or other
  modified_base (228)..(228): a, c, t, g, unknown or other
  modified_base (242)..(242): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctcagtgtcgtggggccccgggnaggagggtcaccatctcctgcacgtgggagcagctccaatntcgggccagattangatgtgcactggtaccagcaacttccaggaacacgacccccaaatcctacatctagtacggtaaaccaacaactccgacccctcgacggggtcccctgacccccgtattcctctcgcctaccgaagtcctggctaccgttcacgtccctcccgtggccctacgtcacgtcgggcctcccgagtcccgtagacggtatggaggccggtatttacgttacgtgacccgtaggtcggtacgaaaggtacgtacgttcggggacgggtaagggactaaaacgggtcctacgggacccggtaccgtagggtaccaccggtacccgaaggccctccggaccccctcgggtaccaccgtccgttccgtccccgtccccg

SEQ ID NO: 376810 - DNA, 608 bp, Homo sapiens
  misc_feature: GZ8MTXP02JDH97.44.10.A10.1.454.CMB.2.raw
  modified_base (240)..(240): a, c, t, g, unknown or other
  modified_base (303)..(303): a, c, t, g, unknown or other
  modified_base (314)..(314): a, c, t, g, unknown or other
  modified_base (356)..(356): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtcttgtctgcaggggatagagcctcctctcctgcaggccagtcagatatggcnccgactactagcctggtaccagcagagacctggccagcctccaggcctcctcatcccacggtncactccaacgngggcccacgtcggccgtccccctgacctaggttcaggtggcnggtcgggtctggggaccaggtacttcactctcaccatcagcacgcctaggacgtccgtagtaagtattttggtagtagttgttaatttacgttagttactatttcccaagttcggttaccctttaccgtcgtaaaccgtttttcggacccgtacgggggtaaaccctaaaacgttacgggtaaaacttaaccgaaaaccgtaaacgttcggtacgggtaccgttacggacctaaccgtacttaccgtttacg

SEQ ID NO: 376811 - DNA, 574 bp, Homo sapiens
  misc_feature: GZ8MTXP02FG7RC.44.10.A10.1.454.CMB.2.raw
  modified_base (445)..(445): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtcttgtctgcaggggatagagcctccctctcctgcagggccagtcagaatattggcgccgactacttagcctggtaccagcagagacctggccagccctccccaggcctccctcatcccgacggtgccactcccaaacgacggggcccacgtcggccgtcccccctgaccagggttccaggtggcagggtggggtctgggggacagtactttcactctcaccatcagcacgcccgtggacgcctagaagtagttttgngtattgtattactgtctagtttccagttcgtcccttacgtcgtaactttcggaccgtacggggaacctaaacgtacggaaaacttacgaaaacgtaacgtggtacggctacggacctaccactcttacg

SEQ ID NO: 376812 - DNA, 566 bp, Homo sapiens
  misc_feature: GZ8MTXP02JJRWL.44.10.A10.1.454.CMB.2.raw
  modified_base (320)..(320): a, c, t, g, unknown or other
  modified_base (355)..(355): a, c, t, g, unknown or other
  modified_base (383)..(383): a, c, t, g, unknown or other
  modified_base (453)..(453): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagagacctggccagccctcccaggctcctcatccacggtgcactccaaacngggccactggcctcccctgaccaggttcagtggcnggtgggtctggggacaggtagttttacnctacactatctcagtctagacgctagaagttatttgacttaagtttacttacgtgtacagtcctaccganaaaggtagtcgacctaactaattacttacctacgtttccggacccgtagggaaacctaaaggtacgtaataacgtaaccgaaaacgtaacgtcggtacgtacgtacgactaac

SEQ ID NO: 376813 - DNA, 608 bp, Homo sapiens
  misc_feature: GZ8MTXP02GFPG0.44.10.A10.1.454.CMB.2.raw
  modified_base (299)..(299): a, c, t, g, unknown or other
  modified_base (310)..(310): a, c, t, g, unknown or other
  modified_base (437)..(437): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagccctccctctcctgcagggccagtcagaatattggcgccgactacttagcctggtaccagcagagacctggccagccctccaggcctccncatcccaggtncactcccaaacgacgggcccacgtcggccgtcccccctgaccgaggttccaggtcggcagggtggggtctggggacagtactttcgactctcaccatcagcacgccgtggacgcctagagtatttgngtattgttattactgtactatttccagttcggttcccttaccgttcgtaaccgttttcgggacccgtaacggggtaaaccctaaaacgttaacgggtaaaacttaaccgtaaaaccggtaaacgttaacggtacggtaccgttacggaccctaaccgtaactccgtttacg

SEQ ID NO: 376814 - DNA, 641 bp, Homo sapiens
  misc_feature: GZ8MTXP02JQEIJ.44.10.A10.1.454.CMB.2.raw
  modified_base (368)..(368): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcgccgactacttagcctggtaccagcagacgacctggccagccctcccgaggcctcctcactcccgacggtgccactcccaaacgacgggccacgtcggccgtccccctgactaggttcagtggcngggtgggtctgggacagacttcactctcaccatcagcacgcccgtggacgccgtagaacgttagttttaggtagttagttaggttactttacgttacgttacttacttttaccgtacgtttccggtttacccctttacccgttaccgttaaccgtttttacgggacccgtaaacgggggtaaaccctaaaacggttacggtaaaacgttaaccgtaaaacggtaaaccgttaaggtacggtaccgtacggaccgtaacctacgtacgtttacg

SEQ ID NO: 376815 - DNA, 578 bp, Homo sapiens
  misc_feature: GZ8MTXP02HV23D.44.10.A10.1.454.CMB.2.raw
  modified_base (319)..(319): a, c, t, g, unknown or other
  modified_base (357)..(357): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagagacctggccagcctcccaggcctcctcatccacggtgcatccaacgngggccacgtggccgtccccctgaccaggttcagtggcngggtgggtctgggacagacttcactctcaccatcacgctagcccgtggacgccgtagaagtgtttttggtgtagtttgttatttacgtgttactacttttccaagtttcggttacccctttaccgtacgttaaccgttttcgggaccgtacgggggaacctaaacgtacggaaaactacgaaaacgtaacgtgtcggacttcggactacctattcgttacg

SEQ ID NO: 376816 - DNA, 580 bp, Homo sapiens
  misc_feature: GZ8MTXP02JZTHB.44.10.A10.1.454.CMB.2.raw
  modified_base (357)..(357): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagagacctggccagccctcccaggctcctcatccacggtgcatccaacagggccacgtggccgtcccccctgacaggttcaggtggcnggtgggtctggggacagactttcactctcaccatcagcagcctggacgcctagaagtattttgtagtatgtattacgtgtctattttccaagttcggttaccctttaccgtacgtaaacgtttttcggaccgtaacgggggaaccctaaaacgtacggtaaaacttaccgaaaacgtaaccgttaaggttacggacgttacggactaacctaacttactttcg

SEQ ID NO: 376817 - DNA, 632 bp, Homo sapiens
  misc_feature: GZ8MTXP02JWB3D.44.10.A10.1.454.CMB.2.raw
  modified_base (319)..(319): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagacgacctggccagcccctcccgaggcctcccgtcactcccgacggtcncaactcccaaacgcgggaccacgtcggcctcccccctgacctaggttccaggtcgggctaggggtcggggtctagggggacagtacctttcactcctaccacctactcacgcacgccgtggacgtccgtagtaagtagttttgtagtattgttattacttgttactactttctagttcggttaccctttaccgtacgttaaaccgtttttcgggaccgtaacggggtaacctaaacggttaacggtaaaactaccgtaaaaccggtaacgtaaggttacggtaccgtacggaccgtacctacgttctttaccg

SEQ ID NO: 376818 - DNA, 575 bp, Homo sapiens
  misc_feature: GZ8MTXP02G8HIB.44.10.A10.1.454.CMB.2.raw
  modified_base (244)..(244): a, c, t, g, unknown or other
  modified_base (341)..(341): a, c, t, g, unknown or other
  modified_base (353)..(353): a, c, t, g, unknown or other
  modified_base (368)..(368): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcncgatactagcctggtaccagcagagacctggccagcctcccaggcctcctcatccacggtgcatcccaacacgggccacgtcggctcccccctgacnggttcagtggcnggtgggtctgggacngacttcactctcacatcagcagcctggacgccgtagaagtatttggtagtatgttatttacgttgttactatttcctattcggttccctttaccgttacgtaacgttttacggaccgtaaggggtaaccctaaaacgtacggtaaaacttaaccgaaaacgtaacgtaaggtacggtaccgttacgacctacctacgtactttaccg

SEQ ID NO: 376819 - DNA, 566 bp, Homo sapiens
  misc_feature: GZ8MTXP02IOWTT.44.10.A10.1.454.CMB.2.raw
  modified_base (373)..(373): a, c, t, g, unknown or other
  modified_base (469)..(469): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagagacctggccagcccctcccgacggcctccctcactcccgacggtcgccactccaacgacgggcccacgtcggccgtccccctgacctaggttcagtcggcngggtgggtctggggactagacttcactcctcaccatcacgcacgccgtaggacgcctagaagttagtttgtagtattgtattactgtactattctnttcggttcccttacgtcgtactttcggacgtacgggaacctaaacgtacgaaactacgaaacgaacgttcgagtactacgaccacgtacttcgttcg

SEQ ID NO: 376820 - DNA, 660 bp, Homo sapiens
  misc_feature: GZ8MTXP02GGBW6.44.10.A10.1.454.CMB.2.raw
tcagacagtatatacacgaccggtgctcgatttagcgtcgatctcaggggagagctctggagaagagctgctcagttaggacccagagggaaccatcggaaaccccagcgcagcttctcttcctcctgctactctgctcccagataacaccggacaacctgtgttgacgcagtctccaggccaccctgtctttgtctgcgaggggatagacgcctccctctcctgcgagggccagtcaagaatagttggcgccgactacttacgcctgtaccagcagacgacctggccagccctccaggcctccctcactcccgacggtcgaccaacgtacccaaacggaccgggccctaacgtcgggacccgttcccccctaggaaccgtagggtttccagggttcggcgtagggggttcggggtcgttagggggaaacctagggtacctttccaacgttccctactacccactccacgccgacggtcccgtaggacgccgtagtaaacgttagttttgtacggtattagtttattacgttagttactatttcctagttccggttaccctttaccgtacgttaacgtttcggaccgtaacggggtaacctaaaacgtacggaaaactaacgaaacgtaacgtgtcggactacgcctaactcgtacttcg

SEQ ID NO: 376821 - DNA, 774 bp, Homo sapiens
  misc_feature: GZ8MTXP02G5YP2.44.10.A10.1.454.CMB.2.raw
  modified_base (167)..(167): a, c, t, g, unknown or other
  modified_base (187)..(187): a, c, t, g, unknown or other
  modified_base (218)..(218): a, c, t, g, unknown or other
  modified_base (245)..(245): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctnagtgtcgtggggccccgggnaggagggtcaccatctcctgcacgtgggacncagctacaatcgccggacagtattagngatgtcgactacgtcggtaccagacctaacgttccgaaggaaccacccgaccccctaaactccctacaacttacgtaagtaacggtaaaaccaaacgtaccgtcccgtaccccgtacggtaccggggttacccctaggaacccccgttactttccgtaccgtaccgtacccttaccgtaacggttccgtacggtacccttaaccgttccgaccgtccccttcccgtacggaccctacgttacccgtaccgggtccggggtcccgttacccggggtacggaggtacgttacgggacggttacgttacgttaacgttttacggtttcggttacgggttcggtaccggggttacggttacgggtaacgttccggtaaacgttacgttaccgggtaggttacggtacggtacgttacggtacggtttacgggtaccggggacggggtaaaccggtaccgtaacgtccggttaaccggtaacccgttaccgtaacgtaccggaaccgtacccggtaacggtcccgttaccccgg

SEQ ID NO: 376822 - DNA, 684 bp, Homo sapiens
  misc_feature: GZ8MTXP02GP1PD.44.10.A10.1.454.CMB.2.raw
  modified_base (167)..(167): a, c, t, g, unknown or other
  modified_base (187)..(187): a, c, t, g, unknown or other
  modified_base (217)..(217): a, c, t, g, unknown or other
  modified_base (263)..(263): a, c, t, g, unknown or other
  modified_base (355)..(355): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctnagtgtcgtggggccccgggnaggagggtcaccatctcctgcacgtgggancagctaccaatagtcgggacagattctgatgtccatggtaccaacnccttccaggaacacgaccccccaaatccctacattcctttaggtaaaccaacttagtccggccctcgacggggttcccctgaccgatttccncctggcctccaagtctggccacctcacgtccctacccgtggcctaatccaacgttcggggcccttccgaagggcctggaggacttggaacggtcttagtaatttacttaccgtcggaccctaaggtacccttaagtacgaaccgtaggttaacgtccttaggagttggtccggtttagggggtacggtttccggggacggggtaacgggggtaaacccgtaaaggggttccggtaacccggttcccgttaaaagggggttcccaaacgggtcccccgtaaaaggggtcccgtttaccggaccccccccggtttcggggtttaacccccg

SEQ ID NO: 376823 - DNA, 642 bp, Homo sapiens
  misc_feature: GZ8MTXP02GWLW6.44.10.A10.1.454.CMB.2.raw
  modified_base (246)..(246): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagacgccctccctctcctgcgagggccagtcagatgtggcncgatacttgcctggtaccagcagacgacctggcccacgccctcccgaggcctcccgtcacgttcccgaggtcgctaactacccgaacgacgggacccacgtcggccgttaccccccgtgaaccgtaggttccaggttcggacgtaggggtcgggtcgtaggggaaccaggtaccttcaaccgtctaccaccatcgacgacgacgccgtaggacgccgtagtaacgttagttttgtagtaagttagttaactttacgttagttacctactttaccgtagttacccggttacccttacgtaccgttaacgtttcggaccgtaacgggtaacctaaaggtacggtaaaactacgaaaacgtacgtaaggtacgtacgtacgacctactactacgtttcg

SEQ ID NO: 376824 - DNA, 664 bp, Homo sapiens
  misc_feature: GZ8MTXP02F7DPP.44.10.A10.1.454.CMB.2.raw
  modified_base (190)..(190): a, c, t, g, unknown or other
  modified_base (220)..(220): a, c, t, g, unknown or other
  modified_base (231)..(231): a, c, t, g, unknown or other
  modified_base (239)..(239): a, c, t, g, unknown or other
  modified_base (243)..(243): a, c, t, g, unknown or other
tcagacagtatatacacgaccggtgctcgatttagcgtcgatctcagggggggcacaagaggcagcactcaggacaatctccagcatggcctggtctcctctcctcctcactctcctcgctcactgcacagggtcctgggcccagtctgtgctgacgcagccgccctcagtgtcgtcggggccccggggnaggagggtcaccatctcctgcacgtgggancagctacaatncgggcagnttangatgtgcactggtaccagcaactccaaggaaccacgacccccaaactccctacactactaagtacggtaaaaccaaaccaactccgtaccccctgaacggggtcccctacggaccccgtacttcctacgtcgaccctaccgaagttccgtaggctaccttcaccgtccctcccgtcgcctaactccacgtcgggccgttcccgggtaccgaggatcggaggtctgtaactttagtttcgtggttcggccggttcggttagggacttcggaactcgttccgtaggaacggttcgggaacgttcggttaccgttaaggttccgggggacggggtaacggggaaccccaaagggtccgtaacggtaacccgttaaccgtaacgttacccggaccggacccgtaacgggtcctttaacccccggg

SEQ ID NO: 376825 - DNA, 573 bp, Homo sapiens
  misc_feature: GZ8MTXP02FYUWL.44.10.A10.1.454.CMB.2.raw
  modified_base (220)..(220): a, c, t, g, unknown or other
  modified_base (393)..(393): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctcaggtgtcgtgggggccccggggcaggagggtcaccatctcctgcactggggancagctccaatgcgggccagattatgatgtgcactggtaccagcaacttccaaggaaccacgacccccaaactcctacactctataggtaacaaacaatccgcccctcgacggggtccctcgaccccgtacttcctctcgccctaccaagtcgtcgcacttccacgtccctccnggcccatccacgtcggccgtccggtaccgaggactggaggctgtatttagtttcgtggttcgcggtcgttagggacgtggactacgttccgtgtaggtggactgtcgttaggttcgggcgggaaaggccaacggctacggaaccgtccgttaagacacgacccgaacggccgttacccgg

SEQ ID NO: 376826 - DNA, 582 bp, Homo sapiens
  misc_feature: GZ8MTXP02G112K.44.10.A10.1.454.CMB.2.raw
  modified_base (315)..(315): a, c, t, g, unknown or other
  modified_base (337)..(337): a, c, t, g, unknown or other
  modified_base (367)..(367): a, c, t, g, unknown or other
tcagacagtatatacacgaccggtgctcgatttagcgtcgatctcaggggagagctctggagaagagctgctcagttaggacccagatggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagatatggcgcgactactagcctggaccagcagagacctggccagcctccaggcctcctcactccgacggtgcactccaacncgggccacgtcggcccgtcccngactaggttcaggttggctaggtgggtccnggggacagacttcactctccacgatccagcacgccgtaggacgccgtagaaagttgttttagtagtattggttattactagttctatttccagttccgttacccctttacgttccgttaacgttttcgggacccgtaacgggggtaacctaaacgttacgggaaaactacgaaaacgtaacgtcgtacgggtactacgacctacctactttaccg

SEQ ID NO: 376827 - DNA, 659 bp, Homo sapiens
  misc_feature: GZ8MTXP02FQSGY.44.10.A10.1.454.CMB.2.raw
  modified_base (267)..(267): a, c, t, g, unknown or other
  modified_base (301)..(301): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcacctgtcttgtctgcaggggatagagcctcctctctgcagggccagtcagaatattggcgcgactactagcctggtaccagcaganacctggccagcctccgagctcctcatccacggtncactcccaacgtacgggccacgtcggccgtccccctagaccgtaggttcaggtcggctgggtcgggtctaggggaccaggtactttcgactcgtacacctatcgagccgaacgcccgtaggaacgtccgtaggtaaacgttagtttttagaggtaacttaggttaactttacgtacgtttaccttaacttttaccgtaacgtttccggttaccccctttaaccgtttaccggttaaaccgtttttacgggacccgttaaaacgggggtaaaccctaaaaacgttaacgggtaaaacttaaccgaaaaccggtacgttaacggtacgggtactacgaccgaacccgtagtctttaccgg

SEQ ID NO: 376828 - DNA, 576 bp, Homo sapiens
  misc_feature: GZ8MTXP02JCMQ1.44.10.A10.1.454.CMB.2.raw
  modified_base (308)..(308): a, c, t, g, unknown or other
  modified_base (344)..(344): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagaatattggcgccgatacttagcctggtaccagcagagacctggccagccctccaggcctcctcatcccacggtnccatcccaacgacgggccacgtcgggcctccccccngacctaggttcaggtggctgggtcgggtctggggacagtacttcgactctcacctatcgacgcacgccgtaggacgccgtagagttagtttgtagtattgtattacgttgtactattactagttcgttacccttacgtcgttaacgttttcggaccgtaacggggtaacctaaacgtacgtaaactaacgaaacgtaacgtggtacgactacgacctaccgtactctttacg

SEQ ID NO: 376829 - DNA, 648 bp, Homo sapiens
  misc_feature: GZ8MTXP02JGF9W.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactactagcctggaccagcagacgacctggccagcccctccgaggcctcctcactcccgacggtcgcactaccaacgacgggccacgtcggcctcccccctgaccgtacggttcaggtcggctagggttcggggtactggggaccagtacttccgactcctcaccatacagcacgccgtaggacgtccgtagaacgttagtttggtagtagttagttatttaacgttgttaccgttactttaccgtaacgttcggttaccccgtttaaccttaccggttaaccgtttttacgggacccggtaacgggggtaaaccctaaaacgttacgggaaaacttaaccgaaaaccggtaaaccgttaaggtacggtacgtacggacctaaccgtacttcgtttaccg

SEQ ID NO: 376830 - DNA, 572 bp, Homo sapiens
  misc_feature: GZ8MTXP02F1DGM.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagaatattggcgccgactacttagcctggtaccagcagagacctggccagccctcccaggcctcctcatccgacggtgcactccaaacgacgggcccacgtcggccgtcccccctaggacctaggtttcaggtggctagggtggggtctgggggacagtacttcactctcaccatcacgcacgccgtaggacgcctagaagtatttgtagtatgttattactgtactatttctagttcgtccttactcgtaacgtttcggaccgtacggggaacctaaacgtacggtaaaactacgtaaaacgtaacgtaagtacggtactacgaccactacttctttcg

SEQ ID NO: 376831 - DNA, 712 bp, Homo sapiens
  misc_feature: GZ8MTXP02JTOZ7.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgctgcgaggggatagacgccttcccgtctcctgcgacgggccagtcagaattgttggcgccgactacgttagcctggtaccagcagagacctggccagccctcccgaggcctcctcatcccgaggtcgcacgtccgaacgagggccctacgtcggaccgtccccctagacctacgggtttccaaggttggggacctaggggttcgggggtactcgggggaaacagggtaaccctttccgaaacgttccttaccgaaccctactaccgaacgtaccgaacggcccgtagggaacggtacccgttagtaaacgttacgttttaggtagtaagtttaggtaaactttccgtagttaccgtaacttttaccgtaaacgtttccggttacccctttaaccgttacgttaaaacggttttcggaacccggtaacgggggtaaaccctaaaacggttaacggtaaaactaccgtaaaacgtaaacgtggtacggtacctacggaccgtaaccgtaactcgtttaccg

SEQ ID NO: 376832 - DNA, 570 bp, Homo sapiens
  misc_feature: GZ8MTXP02IA685.44.10.A10.1.454.CMB.2.raw
  modified_base (353)..(353): a, c, t, g, unknown or other
  modified_base (369)..(369): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcgccgatacttagcctggtaccagcagagacctggccagccctccaggcctcctcatcccaggtgcatccaacagggccacgtcggcgtccccctgacaggttcagtggcnggtgggtctggggacnggtacttcgactctcaccatcagcacgccgtggacgccgtagaagtatttgtagtagttgtatttacgtgtactatttctatcggttcccttaccgtcgtaacttttcggaccgtacggggaaccctaaaacgtacgggtaaaactaacgtaaaacgtaacgttcgtacggtacgtcgacctaccgtaacgtaccgtttcg

SEQ ID NO: 376833 - DNA, 604 bp, Homo sapiens
  misc_feature: GZ8MTXP02FXVRU.44.10.A10.1.454.CMB.2.raw
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtcttgtctgcaggggatagagcctcctctcctgcagggccagtcagaatatggcgcgactacttagcctggtaccagcagacgacctggccagccctcccaggcctcctcactcccgacggtgcactccaacgacgggccagtcggcctcccctagactaggttcagtcggctaggggtcgggtctaggggaccagtactttccgaaccttctccaacctactacgagccgacgcccgtaggacgtccgtagaagttagttttgtagtagttagttattacgttacgttactactttcgtaacgttcggttacccctttaccgtacgttaacgttttcggaccgtaacggggtaacctaaacgtacgtaaacgtacgaaacgtaacgtggtacgtactacgacctacacgtcttacg

SEQ ID NO: 376834 - DNA, 706 bp, Homo sapiens
  misc_feature: GZ8MTXP02GT4BA.44.10.A10.1.454.CMB.2.raw
  modified_base (189)..(189): a, c, t, g, unknown or other
  modified_base (248)..(248): a, c, t, g, unknown or other
  modified_base (382)..(382): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctcaggtgtcgtcggggccccgggnaggagggtcaccatctcctgcacgtgggagcagctaccaatacgtcgggccagtattangatgtgcacgtggtaccagacctaacttccgaaggaaaccaccgaccccccaaactccctacaacttctaatacggtaaaccaaactaactcccgacccctagacggggtcccctagaccccgtattcctctcncctaccaagtcctcgactaccttcaccgtcccctacccgtcggaccctagtccgaccgtcggggtcccgttccccggggtacggacggtaacgttcgggaacgggttcctaggttaaactttacttttccggtggttcgggtccgggttcgggttagggtacgtacgaacgtcgttaccgtggtacgggttagaaccgttggtaccgttacggttaccggggaccggggaaacgggtacccgtaaacggtccgtaccggttaaaccccgtaccgttaaacggtacccgaacccggtacccgtaacggggtccttcccccccggg

SEQ ID NO: 376835 - DNA, 622 bp, Homo sapiens
  misc_feature: GZ8MTXP02IXMAW.44.10.A10.1.454.CMB.2.raw
  modified_base (187)..(187): a, c, t, g, unknown or other
  modified_base (218)..(218): a, c, t, g, unknown or other
  modified_base (248)..(248): a, c, t, g, unknown or other
  modified_base (618)..(618): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctcagtgtcgtggggccccgggnaggagggtcaccatcctcctgcacgtgggancagctcaatagtcgggcagtattatgatgngcactgtaccagctaacttccgaggaaaccacgaccccctaaatccctacactctaatggtaaaacaacaactccgcccctacgaccggggtccctagaccccgtattcctctcgtccctaccgtaagtccgtacgcctaccgtttaccgaccgtcccttccccgtcggccctaactccgtaaccgtcgggggtcccttcccggggtaccggaacgggtagtcgggaacgggtcctaggtaacgttttacgtttcgtacggttcggtccggtcggtttggggactaggactacgtccgtagaggtgacgtcgtacttaggtcggacggtacggaccagtcctagccgtacacggtcaacgtccgacgtcncccg

SEQ ID NO: 376836 - DNA, 564 bp, Homo sapiens
  misc_feature: GZ8MTXP02GNHSM.44.10.A10.1.454.CMB.2.raw
  modified_base (444)..(444): a, c, t, g, unknown or other
tcagacagtatatacacgaccggtgctcgatttagcgtcgatctcaggggagagctctggagaagagctgctcagttaggacccagagggaaccatggaaacccccagcgcagcttctcttcctcctgctactctggctcccagataacaccggacaacctgtgttgacgcagtctccaggcaccctgtctttgtctgcaggggatagagcctccctctcctgcagggccagtcagaatatggcgccgactacttagcctggtaccagcagagacctggccagccctcccgaggcctccctcactcccgacggtgccatcccaacgcggggccacgtggccgtccccctgacctaggttcaggttcggcgaggtggggtctgggggacagtactttcgactctcaccatcagcacgccgtggacgccgtagaacgtattttggngtatgttattactgtctatttccattcgtcccttacgtcgtaacgtttcggaccgtagggacctaaacgtcggaaactacgaaacgtaacgtggtacgctacgacacctattcctttacg

SEQ ID NO: 376837 - DNA, 715 bp, Homo sapiens
  misc_feature: GZ8MTXP02G5K8L.44.10.A10.1.454.CMB.2.raw
  modified_base (310)..(310): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgctgcaggggatagagcctccctctcctgcagggccagtcagaatattggcgccgactacttagcctggtaccagcagagacctggccagccctccaggcctcctcatcccgacggtncactaccaaacgacgggcccaacgtcggccgtccccccctagaacctagggtttccaggttcgggacctaggggttcggggtactgggggaacctaagggtacctttccaaccttcctaccctaaaccctacttaccgaacggcccgaacggcccgttagggaacgtcccgttagggtaaacgttagtttttacggtaggttattaggttaactttaacgttacggttaccttaacgttttaccctaacgtttccgggtttaccccctttaaccgttaccggttaaaaccgtttttcgggacccgttaaacgggggtaaaccctaaaacgttacgggtaaaactaccgtaaaacggtaaacgttcggtacgggtacttacggaccgaaccctaagttacctttcg

SEQ ID NO: 376838 - DNA, 631 bp, Homo sapiens
  misc_feature: GZ8MTXP02HBOZ3.44.10.A10.1.454.CMB.2.raw
  modified_base (168)..(168): a, c, t, g, unknown or other
  modified_base (190)..(190): a, c, t, g, unknown or other
  modified_base (222)..(222): a, c, t, g, unknown or other
  modified_base (244)..(244): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagcccgccctnagtgtcgtcgggggccccgggnaggagggtccaccatcctcctgcacgtgggancagctcaatgcgggcagattangatgtgcacgtcggtaccagcaacttccgaaggaaccacgacccccaaactcctacactactagtacgtaaacaacaactcccgacccctacgtacggggtccctagaccccgtacttcctctcgaccctaccgaagtccgtcgcctacttccacgtcccctccgtcgcctactccgaccgtcgggccctcccggtcggaggactggagtctagtacgtttattcgtggttggccggttggttaggggacttcggactacgtccgtaggtacggtacgtcgttcggtcgttaggttccggggacgggtaacgggacctaacggtccgtacggaacccgttaccgtaaacggtccggaacgaccccggtaacggtcccgtacccccgg

SEQ ID NO: 376839 - DNA, 743 bp, Homo sapiens
  misc_feature: GZ8MTXP02IPZ9N.44.10.A10.1.454.CMB.2.raw
  modified_base (167)..(167): a, c, t, g, unknown or other
  modified_base (190)..(190): a, c, t, g, unknown or other
  modified_base (221)..(221): a, c, t, g, unknown or other
  modified_base (472)..(472): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctnagtgtcgtcgggggccccggggnaggagggtcaccatcctcctgcacgtgggancagctccaatacgtcgggaccagtattatgatgtgcacgtggtaccagacctaaccttccgaacggaaccaccgaccccccaaaacttccctacgtaacttacctaagtaacggtaaaaccaaaacctaacgttccccgaccccccgttacggtacccgggggttacccctacggtaacccccgtactttcccttaccgtccggtcccccttaacccgtaaacgttccgtacggaccttacccgtttaccnccgtccccctccccgttcggaccctacgtcccgtacgtcggggtcccgttccccggggtaccggtacggtagtcggaacggtcgtagttactttacgtttcgtggtcggtcgggttcgttagggacgtacgtacgtcgttccgtaggtacggtcgtacgttcggtacgttacggttccggggacgggaaccgggtaaccaacggtccgttaacggtaacccgttaccgtaacggtaccgaaccggtacccggtaaccggtccgtcccccgg

SEQ ID NO: 376840 - DNA, 721 bp, Homo sapiens
  misc_feature: GZ8MTXP02GE0Q5.44.10.A10.1.454.CMB.2.raw
  modified_base (517)..(517): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtcttgtctgcaggggatagagcctccctctcctgcagggccagtcagaatgttggcgccgactacttagcctggtaccagcagacgacctggccacgccctccccgaggtcctccctcatcccacggtcgacctacgtaccaaacgacgggcccaacgtcgggaccgtcccccgtaggaccgtacgggtttcacggtcggccgtaggggtcgggtcgtacgggggacctacggtaacctttccgaaaccttcctaccaaaccccgtagtaacccgacgacccgtaacgcccggttgggaaccggtaccctaggtaaagttcgttttaggnggtacttaggttacttaacgttcgttaccgttaatttcccgtaacgtttcccggttaccccgtttaacctacggtttaaacccgttttcgggaccccggtaaaggggtaacccccgtaaaagttaacggtaaaacgtaaccgtaaaacgtaaaccgttgggtacggtaccgtaacggtaccaaaaccggttacttccgtttacg

SEQ ID NO: 376841 - DNA, 658 bp, Homo sapiens
  misc_feature: GZ8MTXP02IB8X1.44.10.A10.1.454.CMB.2.raw
  modified_base (214)..(214): a, c, t, g, unknown or other
  modified_base (224)..(224): a, c, t, g, unknown or other
  modified_base (236)..(236): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctcagtgtctggggcccgggcaggagggtcaccatctcctgcactgggancagctcaatntcggcagattangatgtgcacgtggtaccagccaacttccgaaggaaccacgaccccccaaatcctacatctatcggtaaacaacatccgcccctagacggggtcccctagaccccgtattcctctcgccctaccgaagtcctggctaacctttccacgtccccttcccgtggccctatccacgtcgggcctccgagccctaggacggtatacggaggtaccgggtaattttacgttaacgttcggacccgtaggttaccggttaccggaaaggtacggtaacggtttccggggacggggtaaacggggtaaccttaaacgggccgtacggtaaaccccggttccgttaaaggggtccaaccggaccccgtaaagggtcctaacccggcccccgttcgggttccaacctcccgttaccgttccccctaaccccg

SEQ ID NO: 376842 - DNA, 828 bp, Homo sapiens
  misc_feature: GZ8MTXP02HRMG0.44.10.A10.1.454.CMB.2.raw
  modified_base (243)..(243): a, c, t, g, unknown or other
  modified_base (309)..(309): a, c, t, g, unknown or other
tcagacagtatatacacgaccggtgctcgatttagcgtcgatctcaggggagagctctggagaagagctgctcagttaggacccagatggaaccatggaaaccccagcgcagcttctcttcctcctgctactctggctcccagataacaccggacaacctgtgttgacgcagtctccaggcaccctgtctttgtctgcaggggatagagcctcctctcctgcagggccagtcagatagtggcncgatacttagcctggtaccagcagacgacctggccagccctccaggtcctcctcatccacgggtcncatccgaaagacgggcccacgtcgggccccgttccccgtagacccgtaggggtttccaagggtttcggggccgtaagggggtttcgggggttaccgttacgggggaacctaaacgggtacccttttaccgaaccctttcccgttaaaccgaaccctaagttacccgaaacgggttcccaaccggtccccggttagggggaaccctcccgttaaagggtaaaacgtttcgtttttttagggtacgttaaagtttggggtttaaacgttttaacccttggttacccgtttaaactttttccccgaaacggtttttacccgggggttttacccccctttaaaaccggtttacccggttttaaaaccgggttttttcccggggaaaccccgggtttaaacgggggtaaaaccccttaaaaacgggttaccggggtaaaaactttaaaccccggaaaaaccggttaacgtttaacggggtacgggttacccttaaggaccccctaaaccggttaacgtttcccg

SEQ ID NO: 376843 - DNA, 681 bp, Homo sapiens
  misc_feature: GZ8MTXP02HHJI2.44.10.A10.1.454.CMB.2.raw
  modified_base (170)..(170): a, c, t, g, unknown or other
  modified_base (191)..(191): a, c, t, g, unknown or other
  modified_base (220)..(220): a, c, t, g, unknown or other
tcagacagtatatacacgaccggtgctcgatttagcgtcgatctcgagggggggcacaagaggcagcactcaggacaatctccagcatggcctggtctcctctcctcctcactctcctcgctcactgcacagggtcctgggcccagtctgtgctgacgcagcccgccctnagtgtcgtcggggccccgggnaggaggtcaccatctcctgcacgtgggancagctacaatgtcggcagtatatgatgtgcacgtcggtaccacgactaacctaccgaacgaaccaccgacccccaaacctcctcaaaaaaactctaagtacgtaaacaaacaactccgaccccgtaccgtaccgggtcccgtacgaccccgtacttcctctcgtcctaccgtacgtccgtcgtactaccttaccgaccgtccctcccgtcgcctactaccgtacgtcgggtccgtcccggtccggacggtacgtacggacggtacgtagttatttacgtttcgttcggttcgggtcgggttacgggttacgggtagttacggtacgtacgttccgtaggtacggtacggtacgtcggtacggttacggttaccggggacggggtaaccggaaccgaacgtaccggtaccggtaacccgtaccgtaacgtaccgaccgacccgtaacggtcccgtaccccgg

SEQ ID NO: 376844 - DNA, 592 bp, Homo sapiens
  misc_feature: GZ8MTXP02FMIUR.44.10.A10.1.454.CMB.2.raw
  modified_base (244)..(244): a, c, t, g, unknown or other
  modified_base (382)..(382): a, c, t, g, unknown or other
tcagacagtatatacacgaccggtgctcgatttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatatggcnccgatactagcctggtaccagcagagacctggccagccctcccaggcctcctcatcccacggtgcctatcccaaacgacggggccccacgtcgggaccgtcccccccgtaggaccgtagggtttcaagggtcggaccngggttcggggtctgggggaccagtacctttcacgtctcacccatcgagcacgccgtaggacgcctagaacgtagtttgtagtatgttattactgtctatttcattcgtacccttaccgtacgtaacgtttcggaccgtacgggtaacctaaacgtacggtaaactaacgaaacgtaactggtacgacgtacgacctaccgtactcttacg

SEQ ID NO: 376845 - DNA, 687 bp, Homo sapiens
  misc_feature: GZ8MTXP02FMO74.44.10.A10.1.454.CMB.2.raw
  modified_base (167)..(167): a, c, t, g, unknown or other
  modified_base (187)..(187): a, c, t, g, unknown or other
  modified_base (244)..(244): a, c, t, g, unknown or other
  modified_base (313)..(313): a, c, t, g, unknown or other
tcagacagtatatacacgaccggtgctcgatttagcgtcgatctcaggggggcacaagaggcagcactcaggacaatctccagcatggcctggtctcctctcctcctcactctcctcgctcactgcacagggtcctgggcccagtctgtgctgacgcagccgccctnagtgtcgtggggccccgggnagaggtcaccatctcctgcacgtgggagcagctccaatatcggccagattatgatgngcactggtaccagcaacttcgaggaacaccgacccccaaatcctacatactataggtaaacaactaacnccgacccctgacggggtccctaggacccccgtattcctactcgaccctaccaagttccgtcgggacctacctttccgaaccgtcccccttcccgtcggaccctatacccgtacggttcggggacccgttccccggggttaccggaacgggtacgtacgggacgggttacctaggttaaacgtttacgtttcgtcggtcgggtccggttcgggtttagggacgtggactacgttcctagggtacggtcggtaacgtcggtacgttaagggtccggggtacgggaaccgggtaaccgtaaacggccgttaaccgaaccccggttaaccgttaaacggtccgaaccggaccccgtaacggggtcccttaacccccgg

SEQ ID NO: 376846 - DNA, 662 bp, Homo sapiens
  misc_feature: GZ8MTXP02FNB87.44.10.A10.1.454.CMB.2.raw
  modified_base (193)..(193): a, c, t, g, unknown or other
  modified_base (297)..(297): a, c, t, g, unknown or other
  modified_base (380)..(380): a, c, t, g, unknown or other
tcagacagtatatacacgaccggtgctcgatttagcgtcgatctcaggggttcacaagaggcagcactcaggacaatctccagcatggcctggtctcctctcctcctcactctcctcgctcactgcacaggtcctgggcccagtctgtgctgacgcagccgccctcatgtctgttccgggtcagatttcaccnctctcctgcacgtggagcagctccaactacgtccgggccgagattatgatgtgcacgtcggtaccacgacaccttaccgacggaacaccgccccgacctcctcnctcttacgtaacaactactccgtccgtccgtacggtccgtcgtaccgaccttcttctcgtctcctacgtctcgtccacctccncgcctcggtccgtccactacctaccgtcggtccgtccgtaccgtctacgtaaagtaagtagtaggggtagggtagtttactttacttacttccgtaccgtaccgttaccttacgtacgaacgacgacgtacccgtaccgtacgttaggtttacggttttgttttcggtttaccggttaccgggtaaaccgggtaacccggtaaccgtaccgtacccggtaacccggttacccggttaccggttaccggtaacccgtaacccgtacccgtacccgtcccccgg

SEQ ID NO: 376847 - DNA, 962 bp, Homo sapiens
  misc_feature: GZ8MTXP02F1AHF.44.10.A10.1.454.CMB.2.raw
  modified_base (251)..(251): a, c, t, g, unknown or other
tcagacagtatatacacgaccggtgctcgatttagcgtcgatctcaggggagagctctggagaagagctgctcagttaggacccagagggaaccatggaaacccccagcgcagcttctcttcctcctgctactctggctcccagataacaccggacaacctgtgttgacgcagtctccaggcaccctgtcttgtctgcgaggggatagacgtcctccctctccgtgcgagggccagtcagtatagttggcncgactactacgcctggtaccagctagacgtaccgtggccaagtcctccgagtctccacactccgaggtcactactaccgaagacgggcctagtcggtcctccccgtagacctaggtcctaaggtcgtacgtacggggtcgggttacctagggggtaacctacgtaaccgtttaccgtacccgttaccgttaaccgaaaccccgttagtacccggttaaaaccggtcccgttaaaccgggtacccgttaacgggggttaaacccgtacccccgggtttaaaagggttaaaacgggttttaccggtttttaacgggggtaccgtttaaaacggtttacccgggtttaaaaccgtttttaaccgggtttacggttttaaccccggtttaaaccggtttttaacccccggaaacggggttttttacccccggggtttaaaccccccgtttttaaacccgggttttaaacccgggggttttaaaaccccgtttttttaaaccccggggggaaacccccggggtttaaaaaacccggggggtttaaaaaaccccccgtttttaaaaaccggggttaaaccgggggtttaaaaaaacccttaaacccccggggtttaaaaccgggttaaaacccggttttccgggggttaaaccggttacccgtaaacggggttaccctttaaacccggttacgtttaaccccgggtttttaacccgg

SEQ ID NO: 376848 - DNA, 621 bp, Homo sapiens
  misc_feature: GZ8MTXP02J0ZHE.44.10.A10.1.454.CMB.2.raw
  modified_base (244)..(244): a, c, t, g, unknown or other
  modified_base (309)..(309): a, c, t, g, unknown or other
  modified_base (319)..(319): a, c, t, g, unknown or other
tcagacagtatatacacgaccggtgctcgatttagcgtcgatctcaggggagagctctggagaagagctgctcagttaggacccagagggaaccatggaaacccccagcgcagcttctcttcctcctgctactctggctcccagataacaccggacaacctgtgttgacgcagtctccaggcaccctgtctttgctgcaggggatagagccctcctctcctgcaggccagtcagaatatggccncgactctagcctggtaccagccagacgacctggccagccctccaggcctccgtcatcccacggtncactcgaacnggcctacgtcggccgtcccctagaaccgtggttcaggtcggtcagggtcgggtagtcgggactagtactttcactcctcacctactacacgcacgccgtaggacgtccgtagtaagtagtttagttccccgtagtagttagttaacgttcgttactactttccgtacgttccgttacccgtttaccgttaccgttaaccgtttacggtaccgtaaccgggtaaccgtaaaacgtaacggtaaaactaaccgtaaaaccgtaacgtaacgtacgtacgtacgtacctacctaacgtcttaccg

SEQ ID NO: 376849 - DNA, 694 bp, Homo sapiens
  misc_feature: GZ8MTXP02HDP41.44.10.A10.1.454.CMB.2.raw
  modified_base (198)..(198): a, c, t, g, unknown or other
  modified_base (218)..(218): a, c, t, g, unknown or other
  modified_base (240)..(240): a, c, t, g, unknown or other
  modified_base (288)..(288): a, c, t, g, unknown or other
  modified_base (299)..(299): a, c, t, g, unknown or other
tcagacagtatatacacgaccggtgctcgattttagcgtcgatctcaggggagagctctggagaagagctgctcagttaggacccagagggaaccatggaaaccccagcgcagcttctcttcctcctgctactctggctcccagataacaccggacaacctgtgttgacgcagtctccaggtcaccctgtctttgtcngcaggggatagagcctcctntcctgcagggccagtcagaatnttggcgccgactacttagcctggtaccagcagacgacctggccagccnccaggcttccnaatccacggtgacataccaaagcgggaccactgggccgtaccccttacgacgtacggttacacggttacgggccgtagggttcgggggttccgttagggggtaacccgagtaaaccggtttccctaacgggttacccttccgaaacccttaactaccggaacggacccgttaaacgcccggtttacggaacggtcccgttaaacggtaaaggttagttttaccggtagttaaacgtttgggttaacgtttacttacggttacttaacgttttacctaagttccgggtttcccttaacgtccgttaaacgtttttcggacccgtaggggtaacctaaacgttcggaacttaacgaaaccgtaagtcgtaggactcggactaccacgttacgttccg

SEQ ID NO: 376850 - DNA, 503 bp, Homo sapiens
  misc_feature: GZ8MTXP01BZI26.15.81.H04.1.454.CMB.2.raw
  modified_base (237)..(237): a, c, t, g, unknown or other
  modified_base (257)..(257): a, c, t, g, unknown or other
  modified_base (277)..(277): a, c, t, g, unknown or other
  modified_base (371)..(371): a, c, t, g, unknown or other
  modified_base (463)..(463): a, c, t, g, unknown or other
  modified_base (496)..(496): a, c, t, g, unknown or other
  modified_base (500)..(503): a, c, t, g, unknown or other
tcagtctacgtagccacgaccggtgctcgatttagtagtgtagattcgcggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttangaggtaactaatcggccctnaggggtttctaatcgcttcnctggctccaagtctggcaacacggcctccctgaccatctctgggctccaggctgaggacgaggctgattattatgcaatctcatatacaaccanagcactctcgactggtattcggcgagggaccaagctgaccgtctaggtcaggcccaaggctcgcccctggcacgtctcgttccccacctccncgctacgttgacttgagcggcttggcaagcgcntagnnnn

SEQ ID NO: 376851 - DNA, 611 bp, Homo sapiens
  misc_feature: GZ8MTXP01EQTBN.15.81.H04.1.454.CMB.2.raw
  modified_base (240)..(240): a, c, t, g, unknown or other
  modified_base (607)..(607): a, c, t, g, unknown or other
  modified_base (609)..(609): a, c, t, g, unknown or other
  modified_base (611)..(611): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggacaaagcaacccaaattcatgatttangagtcactaatccggcctcgaggggtttctaatcgctctctggctccaagtctggacaacacggcctccctgaccatctcgtgggctccaggctgaggacgaggcctgtattattattgactatctacaataactaaccaaaccaacacgtacctactctcgacgttgggtaacgttcgggacgggaggtaccaaagctacgaccgtacctaggtccgacgtacccgaacgggtccctaccggcccccccgttcggtacctaaccgttccgttcccgttaccccctaccccgttccctccggtacccttacggtacgttaaccgtggaacggccggggcttaggggccaagggtcccgacacgttangngn

SEQ ID NO: 376852 - DNA, 536 bp, Homo sapiens
  misc_feature: GZ8MTXP01A3IEH.15.81.H04.1.454.CMB.2.raw
  modified_base (234)..(234): a, c, t, g, unknown or other
  modified_base (270)..(270): a, c, t, g, unknown or other
  modified_base (291)..(291): a, c, t, g, unknown or other
  modified_base (489)..(489): a, c, t, g, unknown or other
  modified_base (499)..(499): a, c, t, g, unknown or other
  modified_base (528)..(528): a, c, t, g, unknown or other
  modified_base (532)..(536): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtgttataactttgtctcctgataccaacagcacccaggcaaagcaccaattcatgattangagtaactatcggccctgagggttctaatcgcttcnctggctccaagtctggcaacnccggcctcccctgacccatctcgtgggcctccgaggcctggaggacgaggctgatttatattgcaattctcaatactaaccaaaccaacagcactcctcgactggtacttcgggcggaagggacccaagctagcccgtcctagggtaccacgggcccaaggcctcggccccctggtccacgtctccgtcccaccctcncgctacgttnacgttgacggcggcttcgggcaagggccntagnnnnn

SEQ ID NO: 376853 - DNA, 556 bp, Homo sapiens
  misc_feature: GZ8MTXP01AF4X6.15.81.H04.1.454.CMB.2.raw
  modified_base (235)..(235): a, c, t, g, unknown or other
  modified_base (272)..(272): a, c, t, g, unknown or other
  modified_base (366)..(366): a, c, t, g, unknown or other
  modified_base (392)..(392): a, c, t, g, unknown or other
  modified_base (551)..(552): a, c, t, g, unknown or other
  modified_base (554)..(554): a, c, t, g, unknown or other
  modified_base (556)..(556): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtgttataactttgtctcctgataccaacagcacccaggcaaagcaccaaattcatgattangagtaactatcggccctgagggtttctaatcgcttcnctggctccaagtctggcaacacggcctccctgaccatctctgggctcaggctgaggacgaggctgattattatgcaatctcatatacaaccaanagcactctcgactgggtacttcgggngggacggaccaagcgtcgacccgtccgtaggtccacgggccccaaggggcctaccggcccccctgggtcctaccgtcctcgttccccaccccttcctccgtctaccggttagaccgttcggacgggtcgggcgttcgggccaaggggccaacgataggnngngn

SEQ ID NO: 376854 - DNA, 643 bp, Homo sapiens
  misc_feature: GZ8MTXP01BVPRW.15.81.H04.1.454.CMB.2.raw
  modified_base (238)..(238): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaaccaaattcatgatttangagtcataatccggcctctaggggttctaatcgctctctggctccaagtctggcaacacgcctccctgaccatctctggcctcgagctgaggacgaggcctgattatatgacatctcatataaccaacaaacagacctactctacgacgtggttaattcgggacggggaacgggaccaaaggccgttacggaacccgttaccgtacgggtaccgaacggaccccgaaacgggtccctccgggccccccccttccgggtttccaaccccgtttccgttcccgttccccccaccccttcccgttccggaccctttaacccgggttacgaacccgttgggaacgggttcccgggggttcttcgggggaacccgaaacgggggtccgacccaaaggttacgggcgcgtg

SEQ ID NO: 376855 - DNA, 507 bp, Homo sapiens
  misc_feature: GZ8MTXP01CH7OD.15.81.H04.1.454.CMB.2.raw
  modified_base (238)..(238): a, c, t, g, unknown or other
  modified_base (257)..(257): a, c, t, g, unknown or other
  modified_base (276)..(276): a, c, t, g, unknown or other
  modified_base (497)..(497): a, c, t, g, unknown or other
  modified_base (500)..(500): a, c, t, g, unknown or other
  modified_base (504)..(507): a, c, t, g, unknown or other
tcagtctacgtagccacgaccggtgctcgatttagtagtgtagattcgcggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaacccaaattcatgatttangagtaactaatcggccctnagggtttctaatcgcttcnctggctcaagtctggcaacacggcctccctgaccatctctgggctccaggctgagacgagctgattattattgcaatctcatatacaacaacagcactctcgactggtacttcggacggagggacccaagctgaccgtctagtcagcccaaggctcgcccctggtcactctcgttccccgcctcctcgctcgttagaccttgacgcggcgttggcaaggcncanacgnnnn

SEQ ID NO: 376856 - DNA, 690 bp, Homo sapiens
  misc_feature: GZ8MTXP01DV3XH.15.81.H04.1.454.CMB.2.raw
  modified_base (240)..(240): a, c, t, g, unknown or other
  modified_base (687)..(687): a, c, t, g, unknown or other
  modified_base (689)..(689): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggacaaagccaaccaaattcatgatttangagtcactaatccggccctgtaggggtttctaatcgtcttctctggtcctaccaagtctggcaacgacggcctccctgaccatctcgtggccttcgaggctcggaggacgacggtctggtatttattattgactattctactaataataaccaaaccaacacgcctaccttctacggtacctagggttacgtttacggggaccgggtaacgggaacccgaaacggtccgtacgtaaccccggttaccgttacggggttaccgaacggtaccccgaaagggtccccttcccggcccccccgtttcgggtaccttacccgtttccgttcccgttcccccggtccccttcccgttcccgggtaccttaaccggtacgttaccgttacgggacgggttccgggttccggttacggggccgtaaaacgggggccctaacgaaaggttcgcgngng

SEQ ID NO: 376857 - DNA, 498 bp, Homo sapiens
  misc_feature: GZ8MTXP02JFU8P.15.81.H04.1.454.CMB.2.raw
  modified_base (236)..(236): a, c, t, g, unknown or other
  modified_base (255)..(255): a, c, t, g, unknown or other
  modified_base (492)..(492): a, c, t, g, unknown or other
  modified_base (495)..(498): a, c, t, g, unknown or other
tcagtctacgtagccacgaccggtgctcgatttagtagtgtagattcgcgggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttangagtaactaatcggccctnagggtttctaatcgcttctctggctccaagtctggcaacacggcctccctgaccatctctgggctccaggctgaggacgaggctgattattattgcatctcatatacaaccaacagcactctcgactggtattcggcggaggaccaagctgaccgtctaggtcagcccaaggctcgccccctgcactctcgttcccgcctctcgctacgtagactgacgcgggctggcaaggcgcanagnnnn

SEQ ID NO: 376858 - DNA, 496 bp, Homo sapiens
  misc_feature: GZ8MTXP02GGM1T.15.81.H04.1.454.CMB.2.raw
  modified_base (232)..(232): a, c, t, g, unknown or other
  modified_base (249)..(249): a, c, t, g, unknown or other
  modified_base (464)..(464): a, c, t, g, unknown or other
  modified_base (493)..(496): a, c, t, g, unknown or other
tcagtctacgtagccacgaccggtgctcgattagtagtgtagattcgcggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaccaaattcatgattangagtaactatcggcctnagggttctaatcgcttctctggctccaagtctggcaacacggcctcctgaccatctctgggctccaggctgaggacgaggctgattattattgcatctcatatacaaaccaacagcactctcgactggtattcggcgagggaccaagctgaccgtctaggtcagcccaaggctgccccctcggtcactctcgttcccgccctcctcgctacgtanactgacgcgggctggcaaggcgacatagnnnn

SEQ ID NO: 376859 - DNA, 526 bp, Homo sapiens
  misc_feature: GZ8MTXP02JUNFS.15.81.H04.1.454.CMB.2.raw
  modified_base (237)..(237): a, c, t, g, unknown or other
  modified_base (523)..(526): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagccacccaggcaaagcaccaaattcatgattangagtaactatcggcctgagggttctaatcgcttctctggctccaagtctggcaacacggcctcctgaccatctctgggctccaggctgagacgaggctgtattattattgcatctcatataacaacaacagcactctcgactgtattcgggacggaggaccaagctagacccgtcgttaaggcacgccccgaaggctccgccccctcggacaccttctcgtttcccccaccctccttccggacctacgtagactcggacgcgggcgtcggcgaaggccgacagtannnn

SEQ ID NO: 376860 - DNA, 523 bp, Homo sapiens
  misc_feature: GZ8MTXP02HKTUL.15.81.H04.1.454.CMB.2.raw
  modified_base (239)..(239): a, c, t, g, unknown or other
  modified_base (258)..(258): a, c, t, g, unknown or other
  modified_base (348)..(348): a, c, t, g, unknown or other
  modified_base (360)..(360): a, c, t, g, unknown or other
  modified_base (521)..(523): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaacccaaattcatgatttangagtcactaatcggccctnaggggtttcaatcgcttctctggctccaagtctggcaacacggcctccctgaccatctctgggcctcaggctgaggacgaggcctgattnttattgcatctnatatacaaccaacagcactctacgactggtattcgggacggtagggaaccaagctggaccgtctaggtcagcccaggctcgccccctggtccacttctcgttccccgcctccctcgtctacggacgactggacgccgggctcggaacgaggcgacagtcgnnn

SEQ ID NO: 376861 - DNA, 492 bp, Homo sapiens
  misc_feature: GZ8MTXP02H251K.15.81.H04.1.454.CMB.2.raw
  modified_base (235)..(235): a, c, t, g, unknown or other
  modified_base (478)..(478): a, c, t, g, unknown or other
  modified_base (485)..(485): a, c, t, g, unknown or other
  modified_base (489)..(492): a, c, t, g, unknown or other
tcagtctacgtagccacgaccggtgctcgatttagtagtgtagattcgcggggggtctcaggaggcagcgctctcaggacatctccaccatggcctgggctctgctgctcctcaccctcctcactcagggcacagggtcctgggtcctccactggaaccagcagtgacgttggtgttataactttgtctcctgataccaacagcacccaggcaaagcaccaaattcatgatttangagtcactaatcgccctgagggttctaatcgcttctctggctccaagtctggcaacacggcctcctgaccatctctggctccaggctgaggacgagcctgattatatgcatctacatactaacaaaccaacagacactctcgaactggtatcggacggaggaccaagctagaccgtcctaggcacgccaaggctcgcccctgctactctcgttcccacctctcgctacgtacacgcgcgcgcngcgagcnctannnn

SEQ ID NO: 376862 - DNA, 507 bp, Homo sapiens
  misc_feature: GZ8MTXP02H1NAN.15.81.H04.1.454.CMB.2.raw
  modified_base (236)..(236): a, c, t, g, unknown or other
  modified_base (246)..(246): a, c, t, g, unknown or other
  modified_base (253)..(253): a, c, t, g, unknown or other
  modified_base (365)..(365): a, c, t, g, unknown or other
  modified_base (367)..(367): a, c, t, g, unknown or other
  modified_base (373)..(373): a, c, t, g, unknown or other
  modified_base (386)..(386): a, c, t, g, unknown or other
  modified_base (499)..(499): a, c, t, g, unknown or other
  modified_base (505)..(507): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctctgataccaacagcacccaggcaaagcaaccaaattcatgattangagtcactancggcctnagggttctaatcgcttctctggctccaagtctggcaacacggcctccctgacccatctctgggctccaggctgaggacgagcctgattatattgcatctcatatacaaccanancactcngactggtatcggnggaggaccaagctgaccgtcctaggtcagcccaagggcctcgccccctcggcacctctccgttccccacccgtcctcgccttacgtacacgtcgacgcgggctggcgaaggcncatcgnnn

SEQ ID NO: 376863 - DNA, 536 bp, Homo sapiens
  misc_feature: GZ8MTXP02JIR8S.15.81.H04.1.454.CMB.2.raw
  modified_base (239)..(239): a, c, t, g, unknown or other
  modified_base (259)..(259): a, c, t, g, unknown or other
  modified_base (375)..(375): a, c, t, g, unknown or other
  modified_base (533)..(533): a, c, t, g, unknown or other
  modified_base (535)..(536): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagccacccaaattcatgatttangaagtaactaatccggcctnaggggtttcaatcgcttctctggctccaagtctggcaacacggcctcctgaccatctctgggctccaggctggaggacgaggctgattagttattgcatctcaatatacaaaccanacgcactctcgactggtattcggacggtacgggaccaaggcgtacgacccgtcctaggtccacgcccgaaggctccgccccctggtccactcctcgttccccaccctcctcgtcctacgtagactggacggtcggcctggcaacggcgacacgtagcncnn

SEQ ID NO: 376864 - DNA, 519 bp, Homo sapiens
  misc_feature: GZ8MTXP02IICF8.15.81.H04.1.454.CMB.2.raw
  modified_base (238)..(238): a, c, t, g, unknown or other
  modified_base (310)..(310): a, c, t, g, unknown or other
  modified_base (358)..(358): a, c, t, g, unknown or other
  modified_base (512)..(512): a, c, t, g, unknown or other
  modified_base (518)..(519): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataacttttgtctcctgataccaacagcaccaggcaaagcacccaaattcatgatttangaggtcactaatcggccctcaggggtttctaatcgcttctctggctaccaagtctggcaacacggcctcccngaccatctctggctccaggctgaggatgacggctgatttattattgcntctcattaactaaccaaccaaacagacactctcgactggtattcggcggaaggaccaagcagaccgtctaggtcagcccgaaggcctcgcccctgtcactctcgtcccaccctctcgtactacgtacgactggacgcggctggcgaacggcganatacgnn

SEQ ID NO: 376865 - DNA, 512 bp, Homo sapiens
  misc_feature: GZ8MTXP02G1NZB.15.81.H04.1.454.CMB.2.raw
  modified_base (203)..(203): a, c, t, g, unknown or other
  modified_base (235)..(235): a, c, t, g, unknown or other
  modified_base (368)..(368): a, c, t, g, unknown or other
  modified_base (455)..(455): a, c, t, g, unknown or other
  modified_base (505)..(505): a, c, t, g, unknown or other
  modified_base (509)..(509): a, c, t, g, unknown or other
  modified_base (511)..(512): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaangcacccaggcaaagcaccaattcatgatttangagtactaatcggcctgagggttctaatcgcttctctggctccaagtctggcaacacgcctcctgaccatctcgtggctcgaggctgaggacgaggctacgtatattatgcattctgattacacaaaccgaanacgcactctcgactgtacgttcggcggagaccaagctagaccgtctaaggtcaacgcccaagctcgacccgtgtcactctcgtcccncctcaccgtctacgtagaccgtgacggcgggcctaggccgaaggcacganagcncnn

SEQ ID NO: 376866 - DNA, 537 bp, Homo sapiens
  misc_feature: GZ8MTXP02J0MG7.15.81.H04.1.454.CMB.2.raw
  modified_base (237)..(237): a, c, t, g, unknown or other
  modified_base (527)..(527): a, c, t, g, unknown or other
  modified_base (536)..(537): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataacattgtctcctgataccaacagcacccaggcaaagcaccaaattcatgatttangagtaactatcgcctcagggtttctaatcgcttctctggctccaagtctggcaacacggcctccctgaccatctctgggctccaggctgagacgagcctgattattattgcatctcatactacaaccaacagcactctcgactggtacttcgggacggacgggacccaaagtcctagaccgttccctaaaggtccacgacccaaggccttcgcccccctcgggtccacttcgtcgtttccccgccctctcgcgtaccgtacgactcggacgcgggctcggaacaacggcnctaagcgcnn

SEQ ID NO: 376867 - DNA, 553 bp, Homo sapiens
  misc_feature: GZ8MTXP02HPUZY.15.81.H04.1.454.CMB.2.raw
  modified_base (202)..(202): a, c, t, g, unknown or other
  modified_base (236)..(236): a, c, t, g, unknown or other
  modified_base (550)..(553): a, c, t, g, unknown or other
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtgttataactttgctcctgataccaacngcacccaggcaaagcaaccaaattcatgatttangaggtaactatccggcctgagggtttctaatcgcttctctggctaccaagtctggcaacacggccctccctgacccatcctcgtgggcctccgaggctggaggacgaggctagtattattacttgctatctctaatataaccaaccaacacgctactctcgactgtacgttcgggacggaggaccaagccgtagacccgtccgtaggtccacgacccgtaaggcctaccggcccccgttcgcctacgtcctccgtccccgcccctccgccgtacctaacgtcactcgaggccgggctggcgaacggcgacagannnn

SEQ ID NO: 376868 - DNA, 546 bp, Homo sapiens
  misc_feature: GZ8MTXP01B8WO2.51.23.C01.1.454.CMB.2.raw
  modified_base (202)..(202): a, c, t, g, unknown or other
  modified_base (260)..(260): a, c, t, g, unknown or other
  modified_base (487)..(487): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccacctctcctgcagggccagtgagagtattgacatcttcttggcctggtaccaanagaaacctggccaggctccccgactcctcatttatgatgcatccaaaaggtcgttggcatccagccaggtcagtgcagtggtcctgggacagaatcgaactctcacatcaccagactagagcctagaagtatttgactagtttattactgttcagtcagacgtaaactaacgtggacttctcgtttcggcggtacggaccgaaggtggagatacgaaagaaacgtgnggacttggactacccagttcttacgttcttctaacttccttcccgcctaacgttcttcg

SEQ ID NO: 376869 - DNA, 514 bp, Homo sapiens
  misc_feature: GZ8MTXP01ACO0R.51.23.C01.1.454.CMB.2.raw
  modified_base (202)..(202): a, c, t, g, unknown or other
  modified_base (260)..(260): a, c, t, g, unknown or other
  modified_base (498)..(498): a, c, t, g, unknown or other
  modified_base (509)..(509): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaanagaaacctggccaggctccccgactcctcatttatgatgcatccaaaagggtcgttggcatcccagccaggttcagtgcagtgggtcctgggacagaattcaactctcaccatcaccagactagagcctgaagtatttgctagtttattactgtcagcagcgtaacaacgtggctctctttcggcggaggaccaaaggtgagatcaaacgaactgttgcttgcaccattcttgtcttnaatctccgctnttctg

SEQ ID NO: 376870 - DNA, 534 bp, Homo sapiens
  misc_feature: GZ8MTXP01AT8KU.51.23.C01.1.454.CMB.2.raw
  modified_base (203)..(203): a, c, t, g, unknown or other
  modified_base (278)..(278): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaanagccaccctctcctgcagggccagtgagagtattgacatcttctggcctggtaccaacagaaacctggccaggcnccccgactcctcatttatgatgcatccaaaaggtcgttggcatcccagccaggttcagtggcagtggtcctggggacagaattcaactctcaccatcaccagactagagcctagaagtatttgctagtttattactgtcagcagacgtaacacgtggcttctcgtttcggcggtaggaccgaagggtggaagatacgaaacgaactggttaggcttgcacattcttgtcttcaacttccttccgctaattcgtaag

SEQ ID NO: 376871 - DNA, 518 bp, Homo sapiens
  misc_feature: GZ8MTXP01D9VCQ.51.23.C01.1.454.CMB.2.raw
  modified_base (201)..(201): a, c, t, g, unknown or other
  modified_base (385)..(385): a, c, t, g, unknown or other
  modified_base (393)..(393): a, c, t, g, unknown or other
  modified_base (498)..(498): a, c, t, g, unknown or other
  modified_base (503)..(503): a, c, t, g, unknown or other
  modified_base (510)..(510): a, c, t, g, unknown or other
  modified_base (516)..(516): a, c, t, g, unknown or other
tcagcgatcgtatacacgaccggtgctcgatttagtacacgtgattagggattggggaggaactgctcagttaggacccagagggaaccatggaagcccagctcagcttctcttcctcctgctactctggctccagataccatcggggaaactgtgttgacacagtctccagccacctgtctttgtctccgaggggaaagngccacctctcctgcagggccagtgagagtatgacattcttcttggcctggtaaccaaacagaaacctggccaggctccccgactcctcatttatgatgcataccaaaaggtcgttggcatccagccaggttcagtggcagtggtcctggggacagaattcaactctcacatcacagactagacnctgaagtntttgctagtttattactgtcagcagacgtaacaacgtggcttctcgtttcggccggagggaccaagggtgagatacgaaacgaatgttggattgcacagttcttntctcnctctccnctgttntg

SEQ ID NO: 376872 - DNA, 522 bp, Homo sapiens
  misc_feature: GZ8MTXP01DM99Q.51.23.C01.1.454.CMB.2.raw
  modified_base (202)..(202): a, c, t, g, unknown or other
  modified_base (260)..(260): a, c, t, g, unknown or other
  modified_base (277)..(277): a, c, t, g, unknown or other
  modified_base (386)..(386): a, c, t, g, unknown or other
  modified_base (510)..(510): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaanagaaacctggccaggcnccccgactcctcatttatgatgcatccaaaaggtcgttggcatcccagccaggttcagtggcagtgggtctggggacagaattcaactctcaccatcaccagactagancctgaagtatttgctagtttattactgtcagcagcgtaacaacgtggacttctcgttcggcggaggaccaaggtgagatacaaagaactgaggcttgccacattcttgtcttcaacttctcccnctaattctaacg

SEQ ID NO: 376873 - DNA, 521 bp, Homo sapiens
  misc_feature: GZ8MTXP01D7QI2.51.23.C01.1.454.CMB.2.raw
  modified_base (204)..(204): a, c, t, g, unknown or other
  modified_base (263)..(263): a, c, t, g, unknown or other
  modified_base (280)..(280): a, c, t, g, unknown or other
  modified_base (383)..(383): a, c, t, g, unknown or other
  modified_base (496)..(496): a, c, t, g, unknown or other
  modified_base (508)..(508): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagngccaccctctcctgcagggccagtgagagtattgacatcttcttggcctggtaaccaanagaaacctggccaggcnccccgactcctcatttatgatgcatccaaaagggtcgttggcatccagccaggttcagtgcagtggtcctgggacagatcaactctcacatcacagactaganctgatatttgctagtttattactgtcagcaggactaacaacgtggactcgttcgttcggcggagggaccaaagggtgagatacaaagaactgagcttgcaccattcttgtctntaactcctcccnctaacgttctaag

SEQ ID NO: 376874 - DNA, 521 bp, Homo sapiens
  misc_feature: GZ8MTXP01EHW16.51.23.C01.1.454.CMB.2.raw
  modified_base (202)..(202): a, c, t, g, unknown or other
  modified_base (495)..(495): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaacctggccaggctccccgactcctcatttatgatgcatccaaaaggtcgttggcatcccagcccaggttcagtgcagtggtctgggacagaattcaactctcaccatcacagactagagctgaagatttgctagtttattactgtcagcagacgtaacaacgtggctctcgtttcggcggtacgggaccgaaaggtggagatacaaacgaactgttggcttgcacgattcngtctcgtcttccgcttatcttcgtaa

SEQ ID NO: 376875 - DNA, 528 bp, Homo sapiens
  misc_feature: GZ8MTXP01C7BL6.51.23.C01.1.454.CMB.2.raw
  modified_base (201)..(201): a, c, t, g, unknown or other
  modified_base (380)..(380): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaangccacctctcctgcagggccagtgagagtatgacatcttcttggcctggtaccaacagaaacctggccaggctccccgactcctcatttatgatgcatccaaaaggtcgttggcatcccagccaggtcagtggcagtggtcctgggacagaattcaactctcacatcaccagactagancctagaagtatttgctagtttattactgtcagcagacgtaacaacgtcggtcttctcgtttcggcggtagggaccgaagggtggaagatacaaacgaactgttggcttgcaccattcttgtcttcaacttccttcccgctaattcgtg

SEQ ID NO: 376876 - DNA, 603 bp, Homo sapiens
  misc_feature: GZ8MTXP01C7BMJ.51.23.C01.1.454.CMB.2.raw
  modified_base (202)..(202): a, c, t, g, unknown or other
  modified_base (260)..(260): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangcccaccctctcctgcagggccagtgagagtatgacatcttcttggcctggtaccaanagaaacctggcaggctccccgactcctctatttatgatgcataccaaaagggtcgttggctatccccagccctaggtcagtggcgaggtgggtcctggggacaggaattcaactctcaccatcacagactagagctagaatatttgactagtttatactgtcagtacagtacgtaaacaacggttcggtcttaccttcgtttcgggacgggaacggggtaacccgtaaagggttcggaagtaacgtaaccgaaaacggtaaaccgtgggttcgggacttacgggccaaccttagttccttgtttccttactaacttcccttccccgacctaacgttcttaacg

SEQ ID NO: 376877 - DNA, 529 bp, Homo sapiens
  misc_feature: GZ8MTXP01DNSXI.51.23.C01.1.454.CMB.2.raw
  modified_base (259)..(259): a, c, t, g, unknown or other
  modified_base (293)..(293): a, c, t, g, unknown or other
  modified_base (412)..(412): a, c, t, g, unknown or other
  modified_base (520)..(520): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaagagccacctctcctgcagggccagtgagagtattgacatcttcttggcctggtaccaanagaaacctggcaggctccccgactcctcatttangatgcatccaaaaggtcgttgcatccagccaggttcagtgcagtgggtcctgggacagaattcaactctcacatcaccagactagagctgaagatttgctagtttattactgtcagcancgtaacaacgtaggcttctctttcggcggtagggaccaaagggtgaaggatcgaaagtaaactgttagggcttggctaccagttcttgtaacttcaacttcttccccnctcttcgtg

SEQ ID NO: 376878 - DNA, 538 bp, Homo sapiens
  misc_feature: GZ8MTXP01BY2P4.51.23.C01.1.454.CMB.2.raw
  modified_base (202)..(202): a, c, t, g, unknown or other
  modified_base (260)..(260): a, c, t, g, unknown or other
  modified_base (277)..(277): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtatgacatcttcttggcctggtaccaanagaaacctggccaggcnccccgactcctcatttatgatgcatccaaaaggtcgttggcatccagccaggtcagtgcagtggtctgggacagaattcaactctcaccatcaccagactagacgcctgaagtatttgactagtttattactgtcagcagacgtaacaacgtggtactctacgtttcgggcggtacggggaccgaagggtcggaagactacgaaacgaactggttaggcttggcacagttcttgtcttcaacttcctccgctaagttctcg

SEQ ID NO: 376879 - DNA, 520 bp, Homo sapiens
  misc_feature: GZ8MTXP01B752D.51.23.C01.1.454.CMB.2.raw
  modified_base (203)..(203): a, c, t, g, unknown or other
  modified_base (242)..(242): a, c, t, g, unknown or other
  modified_base (256)..(256): a, c, t, g, unknown or other
  modified_base (268)..(268): a, c, t, g, unknown or other
  modified_base (284)..(284): a, c, t, g, unknown or other
  modified_base (509)..(509): a, c, t, g, unknown or other
  modified_base (517)..(517): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaanagccacctctcctgcaggcagtgagagtatgacatcttntggctggtaccaanagaactgcagcncccgactcctcattangatgcataccgaaaaggtcgttggcatcccagccaggttcagtgcagtggtcctgggacagaattcaactctcacatcacagactagagcagaatatttgactagttattactgtcagcagtacgtaacaacgtggctctcgttcggcggacgggacctaagggtgaagataccgaaacgaatgaggcttgacaccttagttccagttctcaacttccttcccgntaacgttntcg

SEQ ID NO: 376880 - DNA, 543 bp, Homo sapiens
  misc_feature: GZ8MTXP01AZD1Z.51.23.C01.1.454.CMB.2.raw
  modified_base (203)..(203): a, c, t, g, unknown or other
  modified_base (361)..(361): a, c, t, g, unknown or other
  modified_base (451)..(451): a, c, t, g, unknown or other
  modified_base (507)..(507): a, c, t, g, unknown or other
  modified_base (537)..(537): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaangccaccctctcctgcagggccagtgagagtattgacatcttcttggcctggtaccaacagaaacctggccaggcctccccgactccctcatttatgatgcataccaaaagggtcgttaggcatcccagccaggttcagtggcagtgggtcctgggganagaatcaactctcaccatcaccagactagacgctagaagtatttgctagtttatactgtcagcagcgtaacacgtggctctcgtttcggnggaggaccgaaagggtggagatacgaaaacgtaacgtgttgggccttggaccaccnttcttgtccttcgtccttcccgcttatccngtaacg

SEQ ID NO: 376881 - DNA, 538 bp, Homo sapiens
  misc_feature: GZ8MTXP01B1MFD.51.23.C01.1.454.CMB.2.raw
  modified_base (202)..(202): a, c, t, g, unknown or other
  modified_base (529)..(529): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccacctctcctgcagggccagtgagagtattgacatcttcttggcctggtaccaacagaaacctggccaggctccccgactcctcatttatgatgcatccaaaaggtcgttggcatcccagcccaggttcagtgcagtgggtcctgggacagaattcaaactctcaccatcaccagactagagcctgaagtatttgctagtttattactgtcagcagacgttaaacaacgtggtacttcgtacgtttcggcgggaagggaccaaagggtggagagtacaaagtaaactggttaggcttgcaccattcttgtcttcaatccgttccnctaattctg

SEQ ID NO: 376882 - DNA, 529 bp, Homo sapiens
  misc_feature: GZ8MTXP01AYHH5.51.23.C01.1.454.CMB.2.raw
  modified_base (202)..(202): a, c, t, g, unknown or other
  modified_base (260)..(260): a, c, t, g, unknown or other
  modified_base (277)..(277): a, c, t, g, unknown or other
  modified_base (498)..(498): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangtcaccctctcctgcagggccagtgagagtattgacatcttcttggcctggtaccaanagaaacctggccaggcnccccgactcctcatttatgatgcatccaaaaggtcgttggcatcccagccaggttcagtgcagtggtcctgggacagaattcaactctcaccatcaccagactagacgcctagaagtatttgactagtttattactgtcagcagacgtaacaacgtggacttctcgtttcgggcggacgggaccgaagggtgagatacgaaacgaactggttaggcttgcncattcttgtctcaatctccgctaattctaag

SEQ ID NO: 376883 - DNA, 546 bp, Homo sapiens
  misc_feature: GZ8MTXP01CBADK.51.23.C01.1.454.CMB.2.raw
  modified_base (280)..(280): a, c, t, g, unknown or other
  modified_base (386)..(386): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagcccaccctctcctgcagggccagtgagagtattgacatcttcttggcctggtaccaacagaaacctggccaggccnccccgactcctcatttatgatgcatccgaaaaggtcgttggcatcccagcccaggttcagtgcagtggtctgggacagtatcaactctcacatcacagactagacncctagaagtatttgacttagtttattactgtcagctagacgtaacaacgtgcttctcgtttcggacggacgggaccgtaagggtgtagatacgaaaacgtaactggttaggcttgctccgattcttgttctcaacttccctcccgactaacttcgtaacg

SEQ ID NO: 376884 - DNA, 519 bp, Homo sapiens
  misc_feature: GZ8MTXP01C7LLY.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccacctctcctgcagggccagtgagagtattgacatcttcttggcctggtaccaacagaaacctggccaggctccccgactcctcactttatgatgcatccaaaaggtcgtggcatcccagccaggtcagtggcagtgggtctgggacagattcaactctcacatcaccagactagagcctgaagtactttgctagttattactgtcagcagcgtaacaacgtggactctcgtttcggcggtagggaccaagggtggagatcaaagaaactgttagggcttgcacagttcttgtctcaatctccgctaattctaag

SEQ ID NO: 376885 - DNA, 529 bp, Homo sapiens
  misc_feature: GZ8MTXP01BJFF1.51.23.C01.1.454.CMB.2.raw
  modified_base (202)..(202): a, c, t, g, unknown or other
  modified_base (260)..(260): a, c, t, g, unknown or other
  modified_base (384)..(384): a, c, t, g, unknown or other
  modified_base (481)..(481): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttctggcctggtaccaaanagaaacctggccaggctccccgactcctcatttatgatgcatccaaaagggtcgttggcatcccagccaggttcagtggcagtgggtctgggacagaatcaactctcacatcaccagactagancctgaagtatttgctaagttttattactgtcagcagacgtaaacaacgtggcttctcgtttcggcggtagggaccaagggtgagatcaaagaactgnggcttgcaccattcttacgtcttcaattccttcccgctaacttctaag

SEQ ID NO: 376886 - DNA, 570 bp, Homo sapiens
  misc_feature: GZ8MTXP01ECA0X.51.23.C01.1.454.CMB.2.raw
  modified_base (201)..(201): a, c, t, g, unknown or other
  modified_base (261)..(261): a, c, t, g, unknown or other
  modified_base (387)..(387): a, c, t, g, unknown or other
  modified_base (395)..(395): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaangccaccctctcctgcagggccagtgagagtattgacatcttcttggcctggtaaccaaanagaaacctggccaggctccccgactccctcatttatgatgcataccaaaagggtcgttggcatcccagccaggttcagtggcagtggtcctgggacagaattcaactctcacatcacagactagancctagaanatttgctagtttattactgtacagcgagacgtaacaacgtggtccttcttcgtttcgggcgggagggaccgaaagggttggaaggtaatacccgaaaaggtaaccgtaggttgggaccttggacaccttagttcttcgtaacttctaacttccgtcccttactaacgttctaacg

SEQ ID NO: 376887 - DNA, 669 bp, Homo sapiens
  misc_feature: GZ8MTXP01BK4DL.51.23.C01.1.454.CMB.2.raw
  modified_base (201)..(201): a, c, t, g, unknown or other
  modified_base (295)..(295): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaangccacctctcctgcagggccagtgagagtattgacatcttcttggcctggtaccaaacagaaacctggccaggcctccccgatcatctatttangatgactacgtaccgaaaagggttcgtaggactactcccgacgccgtaggttcgaggtcggcgtaggtcgggtcgtagggactagtaacttccactcctacacctataccaaccaggactaagacgtcctaggtaagttatttgacttaaggttttacttacgttcggtacagtactaacgtaccgttaaacgtaacgttcgggtccttaccgtttcggtttaccggggaccgggggtaacgggtaaacccggtaaggggttacggaaagtacgtaaccgaaaacggtaacgttgggtacgggttctacggacccttaccgttacttcggttcgttaccttcctacgtttccccttccccggtcttaacttccg

SEQ ID NO: 376888 - DNA, 560 bp, Homo sapiens
  misc_feature: GZ8MTXP01AT3OG.51.23.C01.1.454.CMB.2.raw
  modified_base (203)..(203): a, c, t, g, unknown or other
  modified_base (277)..(277): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaanagccaccctctcctgcagggccagtgagagtatgacatcttctggcctggtaccaacagaaacctggccaggcnccccgactcctcatttatgatgcatccaaaagggtcgttggcatcccagcccaggttcagtggcaggtgggtcctgggacagaattcaactctcaccatcaccagactagagcctgaaagtattttgcttagtttattactgtcagcagacgtaacaacgtgggtaccttcgttccgtttcgggcgggtagggacccgaaaggggtggaagatacgaaaacggaatggttaggcttgccacagttcttagttcctcaacttccttccccgctaacttcgtaag

SEQ ID NO: 376889 - DNA, 558 bp, Homo sapiens
  misc_feature: GZ8MTXP01DZ9D1.51.23.C01.1.454.CMB.2.raw
  modified_base (202)..(202): a, c, t, g, unknown or other
  modified_base (260)..(260): a, c, t, g, unknown or other
  modified_base (277)..(277): a, c, t, g, unknown or other
  modified_base (294)..(294): a, c, t, g, unknown or other
  modified_base (382)..(382): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaanagaaacctggccaggcnccccgactcctcattangatgcataccaaaaggtcgttggcatcccagccaggttcagtgcagtggtcctggggacagaatcaactctcacatcacagactaganctagaagtatttgctagtttatactgtcagcagacgtaacaacgtggtactctcgtttcggcggacggggaccaaagggtggaagaacgttacgaaaacggtaactggttcggacttcggactaacccagttccttcgttccttctaacttccctacccgcctaagttccctaagg

SEQ ID NO: 376890 - DNA, 624 bp, Homo sapiens
  misc_feature: GZ8MTXP01BG3ER.51.23.C01.1.454.CMB.2.raw
  modified_base (265)..(265): a, c, t, g, unknown or other
  modified_base (282)..(282): a, c, t, g, unknown or other
  modified_base (387)..(387): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagagccaccctctcctgcagggccagtgagagtattgactatcttcttggcctggtacccaaanagaaacctggccaggcnccccgactcctcatttatgatgcatccaaaagggtcgttggcatcccagccaggttcagtggcagtggtctgggacagattcaactctcacatcacagacagacnctagaatatttgctagtttattactgtcagtcagtacgtaaactacgtacggtcttacgtccgtttacgggcgggtaacggggacccgtaaaggggttcggaaggtaacgtaccgtaaaaacggtaacgttaggttcggggtaaccttgggaccctaacccgttacttccggttacggtttccctttacctaaccttttccccgtttaccccggttaccctaactttccccgttcgg

SEQ ID NO: 376891 - DNA, 543 bp, Homo sapiens
  misc_feature: GZ8MTXP01DBC6A.51.23.C01.1.454.CMB.2.raw
  modified_base (201)..(201): a, c, t, g, unknown or other
  modified_base (258)..(258): a, c, t, g, unknown or other
  modified_base (345)..(345): a, c, t, g, unknown or other
  modified_base (394)..(394): a, c, t, g, unknown or other
  modified_base (497)..(497): a, c, t, g, unknown or other
  modified_base (517)..(517): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaangccacctctcctgcagggccagtgagagtattgacatcttcttggcctggtaccaanagaaacctggccaggctccccgactcctcatttatgatgcatccaaaaggtcgtggcatcccagcccaggtcagtggcagtgggtcnggggacagaattcaactctcaccatacacagactagacgcctagaagtntttgcttagtttattactgtacagacagacgtaaacaagtcggtcttacttcgtttcgggcggagggaccgaagggtgagtatacgaaacgaataggttggcngtccaccagttcttgttctntaacttcctcccgctaacttcgtaag

SEQ ID NO: 376892 - DNA, 633 bp, Homo sapiens
  misc_feature: GZ8MTXP01B80H1.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangcccaccctctcctgcagggccagtgagagtattgacatcttctggcctggtaccaacagaaacctggccaggctccccgactcctcatttatgatgcatccaaaagggtcgttggcatcccagccaggttcagtggcagtgggtcctgggacagatcaactctcaccatcaccagactagagcctgaagtatttgctagtttattactgtcagcagtacgtaaacaacgtggtacttccgttcgtttcgggacggggaacggggtaacccgtaaaggggttagggaacggtaagttaaccgaaaaccgggtaaaccgttgggttacgggggtcccttacgggaaccctacccgttaactttccgttacgggtttccctttaccgtaacgtttccccgtttcccccgaccttaactttcccgtttaacggg

SEQ ID NO: 376893 - DNA, 509 bp, Homo sapiens
  misc_feature: GZ8MTXP01BMMFF.51.23.C01.1.454.CMB.2.raw
  modified_base (201)..(201): a, c, t, g, unknown or other
  modified_base (259)..(259): a, c, t, g, unknown or other
  modified_base (379)..(379): a, c, t, g, unknown or other
  modified_base (388)..(388): a, c, t, g, unknown or other
  modified_base (492)..(492): a, c, t, g, unknown or other
  modified_base (503)..(503): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccaggggaaangcccaccctctcctgcagggccagtgagagtattgacatcttctggcctggtaccaanagaaacctggccaggctccccgactcctcatttatgatgcatccaaaaggtcttggcatcccagccagttcagtgcagtggtctgggacagattcaactctcaccatcacagactagacncctgaagtntttgactagtttattactgtcagcagacgtaacacgtggacttctcgttcggcgacgggacagggtgagatacgaaagaactgagcttgcacattcttgtctcnctcctccgctnttcgtg

SEQ ID NO: 376894 - DNA, 542 bp, Homo sapiens
  misc_feature: GZ8MTXP01CVN4S.51.23.C01.1.454.CMB.2.raw
  modified_base (201)..(201): a, c, t, g, unknown or other
  modified_base (261)..(261): a, c, t, g, unknown or other
  modified_base (296)..(296): a, c, t, g, unknown or other
  modified_base (373)..(373): a, c, t, g, unknown or other
  modified_base (395)..(395): a, c, t, g, unknown or other
  modified_base (515)..(515): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctcaggggaaangcccaccctctcctgcagggccagtgagagtattgacatcttcttggcctggtaaccaanagaaacctggccaggctccccgactcctcatttangatgcataccaaaagggtcgttggcatccccagcccaggtcagtggcagtggtctgggacagaattcaactctcacntcacagactagacgctgaagtnttttgctaagttttattacgtgttcagtacacgtacgtaaacaacgttcggtcttccgttcgtttcgggcggagggaccaaggggtgagatacgaaacgaactgttggcttgcacattcngttctcaacttcctccgctaagttctg

SEQ ID NO: 376895 - DNA, 595 bp, Homo sapiens
  misc_feature: GZ8MTXP01ERHSU.51.23.C01.1.454.CMB.2.raw
  modified_base (204)..(204): a, c, t, g, unknown or other
  modified_base (298)..(298): a, c, t, g, unknown or other
  modified_base (354)..(354): a, c, t, g, unknown or other
  modified_base (366)..(366): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggcccccagataccatcggggaaactgtgttgacacagtctccagccaccctgtctttgtctccgaaggggaaanacgccaccctctcctgcagggccagtgagagtatgacatcttctggccctggtaccaacagaaacctggccaggctccccgactcctcatttangatgcatccgaaaagggtcttggcatccagccaggttcagtgcagtggtctggganagatcactctcncatcacagactagagcctgaagtatttgactagtttattactgtacagcagcgtaaacaacgtcggggctacgttcgttcgggacggaggaccgtaagggtggagtagtacgaaaacgtaacgtggtacggcgtacggccgtaacccgtaattccgtttcggttaaccctttcgtaaaccgtttcccttttcccccggaccttaacgtttccgttaacgtttaacccgg

SEQ ID NO: 376896 - DNA, 537 bp, Homo sapiens
  misc_feature: GZ8MTXP01EDIMP.51.23.C01.1.454.CMB.2.raw
  modified_base (203)..(203): a, c, t, g, unknown or other
  modified_base (261)..(261): a, c, t, g, unknown or other
  modified_base (504)..(504): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaangccaccctctcctgcagggccagtgagagtattgacatcttcttggcctggtaccaanagaaacctggccaggctccccgactccctcactttatcgatgcatcccaaaaggtcgttgcatccagccagttcagtgcagtggtcctggggacagaatcaactctcaccatcacagactagagcctagaagtatttgactagtttattactgtcagcagactaaacaacgtggcttctctttcggcggaggtaccaaggtgagactacgaaacgaactgttggacttcggcaacagttcttnttcttcaacttcctcccgactaacgttcctaag

SEQ ID NO: 376897 - DNA, 532 bp, Homo sapiens
  misc_feature: GZ8MTXP01A44CX.51.23.C01.1.454.CMB.2.raw
  modified_base (201)..(201): a, c, t, g, unknown or other
  modified_base (258)..(258): a, c, t, g, unknown or other
  modified_base (479)..(479): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaangccacctctcctgcagggccagtgagagtattgacatcttcttggcctggtaccaanagaaacctggccaggctccccgactcctcattatgatgcatccaaaaggtcgttggcatcccagccaggttcagtgcagtggtcctgggacagattcaactctcaccatcacagactagagcctgaagtatttgctagtttatactgtcagcagacgtaacaacgtggtctcttcgttcggcggtaggaccgaagggtggaagatacgaaacgtaactggnggcttggcaccttagttcttgtcttctaacttccttcccgctaagttcctaag

SEQ ID NO: 376898 - DNA, 543 bp, Homo sapiens
  misc_feature: GZ8MTXP01ASZV5.51.23.C01.1.454.CMB.2.raw
  modified_base (203)..(203): a, c, t, g, unknown or other
  modified_base (278)..(278): a, c, t, g, unknown or other
  modified_base (388)..(388): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagngccaccctctcctgcagggccagtgagagtattgacatcttcttggcctggtaccaacagaaacctggccaggcnccccgactcctcatttatgatgcatccgaaaagggtcgttggcatcccagccaggttcagtggcagtgggtcctgggacagaatcaactctcaccatcacagactagacncctagaacgtattttgacttagttttattactgtcagcagacgtaacaacgtggtctacttcgttcgggcggaggacgaaggtggaagatacgaaacgaactgttggcttgccacagttcttgtccttctcttccttcccgcctaacttctaacg

SEQ ID NO: 376899 - DNA, 616 bp, Homo sapiens
  misc_feature: GZ8MTXP01CNGNV.51.23.C01.1.454.CMB.2.raw
  modified_base (203)..(203): a, c, t, g, unknown or other
  modified_base (282)..(282): a, c, t, g, unknown or other
  modified_base (293)..(293): a, c, t, g, unknown or other
  modified_base (357)..(357): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaancgcccaccctctcctgcagggccagtgagagtattgacatcttcttggcctggtaccaacagaaacctggaccaggccnccccgactccnctatttatgatgacataccgaaaaggtcgttgcactcccagcctaggtcagtgcaggtcggtcnggacagaattcaactctcacctatacaccagactagacgtcctagtaacgtatttggacttaagtttattacgttgtacaggactacgacgtaaactaacggtggtccttacgtccgtttacggggacggtaacgggaccgtaaagggtcggaaatacgttacgaaaacggtaacttggcggttaccaggaacctacccgttaattccgttacgtttcctacctaacttccccgttcccgaccttaacttcccgttaag

SEQ ID NO: 376900 - DNA, 526 bp, Homo sapiens
  misc_feature: GZ8MTXP01DF8I4.51.23.C01.1.454.CMB.2.raw
  modified_base (257)..(257): a, c, t, g, unknown or other
  modified_base (274)..(274): a, c, t, g, unknown or other
  modified_base (293)..(293): a, c, t, g, unknown or other
  modified_base (507)..(507): a, c, t, g, unknown or other
tcagcgatcgtatacacgaccggtgctcgatttagtacacgtgattagggattgggaggaactgctcagttaggacccagagggaaccatggaagcccagctcagcttctcttcctcctgctactctggctccagataccatcggggaaactgtgttgacacagtctccagccaccctgtctttgtctccaggggaagagccacctctcctgcagggccagtgagagtattgacatcttcttggcctggtacccaanagaaacctggccaggcnccccgactcctcatttatnatgcatccaaaaggtcgttggcatcccagcccaggttcagtggcagtggtcctgggacagattcaactctcacatcacagactagagctgaagtatttgctagtttacttactgtcagcagcgtaaacacgtggtcttctcgtttcgggcggagggtaccgaaaggtgggaacataccgaaagaactgttggacttgcaccattcttgtctctntctcccgctaacttctaag

SEQ ID NO: 376901 - DNA, 549 bp, Homo sapiens
  misc_feature: GZ8MTXP01B2QSH.51.23.C01.1.454.CMB.2.raw
  modified_base (203)..(203): a, c, t, g, unknown or other
  modified_base (278)..(278): a, c, t, g, unknown or other
  modified_base (296)..(296): a, c, t, g, unknown or other
  modified_base (384)..(384): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagngccaccctctcctgcagggccagtgagagtattgacatcttcttggcctggtaccaacagaaacctggccaggcnccccgactcctcatttangatgcatccaaaaggtcgttggcatcccagccaggttcagtggcaggtggtctgggacagattcaactctcacatcaccagactagancctgaagtatttgactagtttattactgtcagcagacgtaacaacgtggtacttctcgtttcggcggagggaccgaagggtggaagatacgaaacgtaactggttacggcttggccaacgttattcttgtaacttcaacttcccgttcccgctaacgttctaacg

SEQ ID NO: 376902 - DNA, 562 bp, Homo sapiens
  misc_feature: GZ8MTXP01EJ19Z.51.23.C01.1.454.CMB.2.raw
  modified_base (203)..(203): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggcctccagataccagtcggggaaactgtgttgacacagtctccagccacctgtctttgtctccgaggggaaancgccacctctcctgcagggccagtgagtagtattgattatcttcttggccttaggtaaccaaacagaaacctggccaggcctccccgactcctcatttatgatgacataccgaaaaggtcgttagcactcccagcctaggttcagtgcaggtggtccgtggacagtattcaactctcactatcacagactagactctagaagtatttgacttagtttactactgtcagcagacgtaacacgtgcttctcgttcggcggaggacgaaggtgagtataacgaaacgtaactggttaggcttcgctaaccttgttcttcgttccttacctaacttccccgtcccgacttaacgttcgtaacg

SEQ ID NO: 376903 - DNA, 532 bp, Homo sapiens
  misc_feature: GZ8MTXP01DZNN7.51.23.C01.1.454.CMB.2.raw
  modified_base (202)..(202): a, c, t, g, unknown or other
  modified_base (276)..(276): a, c, t, g, unknown or other
  modified_base (382)..(382): a, c, t, g, unknown or other
  modified_base (443)..(443): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaagngccacctctcctgcagggccagtgagagtattgacatcttcttggcctggtaccaacagaaacctggccaggcnccccgactcctcatttatgatgcatccaaaaggtcgttggcatcccagccaggttcagtggcagtgggtctgggacagtatcaactctcacatcacagactagacnctagagtatttgactagtttatactgtcagcaagactaacaacgtggctcttcgtttcggnggacgggacgaagggtggaggatacgaaacgtaactgaggcttgccaacattcttagtcttcaacttccttcccgactaattccgtaag

SEQ ID NO: 376904 - DNA, 544 bp, Homo sapiens
  misc_feature: GZ8MTXP01EFB2Z.51.23.C01.1.454.CMB.2.raw
  modified_base (203)..(203): a, c, t, g, unknown or other
  modified_base (510)..(510): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcagggaaactgtgttgacacagtctccagccaccctgtctttgtctccgaggggaaangccaccctctcctgcagggccagtgagagtattgacatcttcttggcctggtaccaacagaaacctggccaggcctccccgactcctcatttatgatgcatccaaaagggtcgttggcatcccagccaggttcagtggcagtcgggtctgggacagaattcactctcaccatcaccagactagagcctgaagtattttgcttaaggttttattactgtcagcagcgtaacaacgttggccttcgtcgtttcggcggagggaccaaggtcggagagtacaaagtaacgttggtcggctcgcaccgttnttctgtacttcacttccttcccgtcttaattccg

SEQ ID NO: 376905 - DNA, 505 bp, Homo sapiens
  misc_feature: GZ8MTXP01E00K9.51.23.C01.1.454.CMB.2.raw
  modified_base (201)..(201): a, c, t, g, unknown or other
  modified_base (259)..(259): a, c, t, g, unknown or other
  modified_base (276)..(276): a, c, t, g, unknown or other
  modified_base (294)..(294): a, c, t, g, unknown or other
  modified_base (391)..(391): a, c, t, g, unknown or other
  modified_base (452)..(452): a, c, t, g, unknown or other
  modified_base (467)..(467): a, c, t, g, unknown or other
  modified_base (476)..(476): a, c, t, g, unknown or other
  modified_base (486)..(486): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaangccacctctcctgcagggccagtgagagtattgacatcttcttggcctggtaaccaanagaaacctggccaggcnccccgactcctcatttangatgcatccgaaagggtcgtgcatcccagccagttcagtggcagtggtctgggacagattcaactctcaccatccaccagactagagcctagaagtntttgctagtttatactgcagcagcgtaacacgtgctctcgttcggcgaggacaaggtgganatacaaagaactggngcttgcacnttcttgtctnaactctcccgctaattctg

SEQ ID NO: 376906 - DNA, 690 bp, Homo sapiens
  misc_feature: GZ8MTXP01DZKYJ.51.23.C01.1.454.CMB.2.raw
  modified_base (204)..(204): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagngcccaccctctcctgcagggccagtgagagtattgactattcttcttggcctaggtaaccaaacgagaaaacctggaccaggcctccccgactcctcactttatgatgcaagtaccgaaaagggtcgttcggactaactccccgagcccgtaggttccaaggttcgggacgtaggtcggggtaccgttggggaaacaggtaaactttccaaaccttctcacctaataccaaccgagaactagacgtacctagaagttatttgacttagtttaatttactgtcagacaagtacgtaaacaacgtggtcttccgttcggtttaccgggacgggtaacgggaaccgtaaaggggttaggaagtaaacgttaaaccgaaaacgtaaacgttgggaacgggtcttaggacccgtaacgttaactttccggttacgttaaccctttcgtaacctttcccggttaccccacccgttaactttcccgttaacgg

SEQ ID NO: 376907 - DNA, 597 bp, Homo sapiens
  misc_feature: GZ8MTXP01C67I4.51.23.C01.1.454.CMB.2.raw
  modified_base (203)..(203): a, c, t, g, unknown or other
  modified_base (302)..(302): a, c, t, g, unknown or other
  modified_base (416)..(416): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaanagcccaccctctcctgcagggccagtgagagtattgactatcttcgtggcctaggtaccaaacagaaacctggccaggcctccccgactcctctattangatgcataccgaaaggtcgttgcactccagccagtcagtgcagtggtcctggacagtatcaactctcaccagtacaccagactagacgctagagtatttgactagtttatactntcagcagtacgtaacacggtgtctacgttcgttacgggcggacgggaaccgtaagggtggaacgtaacgttaaccgaaaacgtaacgttggttacgggaccgttcgaacctaacccttaggttccttacggtttccttaacctcgttccccttccccggttaccctaaggttcccttaagg

SEQ ID NO: 376908 - DNA, 547 bp, Homo sapiens
  misc_feature: GZ8MTXP01DCW4R.51.23.C01.1.454.CMB.2.raw
  modified_base (201)..(201): a, c, t, g, unknown or other
  modified_base (524)..(524): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaangccacctctcctgcagggccagtgagagtattgacatcttcttgggcctgggtaccaaacagaaacctggccaggctccccgactcctcattatgatgcataccgaaaaggtcgttaggcatcccagcctaggttcagtgctagtgggtcctgggacagaatcaactctcaccataccaccagactagacgcctagaagtatttgacttaagtttattactgtacgagctagactaaaccaagtcggcttgtccgttcggccggaagggtaccgaaggtgagactacgaaaccgaatgaggtcttgaccacattcttgtctcncgtccttccgctaacgttctaag

SEQ ID NO: 376909 - DNA, 706 bp, Homo sapiens
  misc_feature: GZ8MTXP01AYVIZ.51.23.C01.1.454.CMB.2.raw
  modified_base (203)..(203): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaancgccaccctctcctgcagggccaggtgagagtattgactattcttcgtggcctaggtaaccaaacaagaaacctggccaggcctccccgactcctctatttatgatgcataccgaaaaggtcgttggcactcccagccgtaggttcagtggcgaggtggtcgtggacagattcaactctcacatcaccagactagacgtcctagtaacgttagttttcgtacttaagtttttaacgttacttgttaccgaagtaccgaagtaacgtaaacctaaacggttcggtcctttaccgttaccggtttaccggggaccggggaacggggtaaacccgtaaagggggttacggaaacggtaacgttaaaccgaaaaccgggtaacgttacgggttacggggtaccttacgggaaccctaaccccttaaagtttccgttaaccgggtttcctttaccgtaacccttttccccgttaccccggttacccttaactttcccgtttaaaccgg

SEQ ID NO: 376910 - DNA, 561 bp, Homo sapiens
  misc_feature: GZ8MTXP01CH8RO.51.23.C01.1.454.CMB.2.raw
  modified_base (260)..(260): a, c, t, g, unknown or other
  modified_base (287)..(287): a, c, t, g, unknown or other
  modified_base (293)..(293): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagcccaccctctcctgcagggccagtgagagtattgacatcttctggctggtaccaanagaacctgccaggctccccgactcctnatttangatgcatccgaaaaggtcgttggcatcccagccaggttcaggtgcagtggtctgggacagtaatcaactctcacatccacagactagcacctgaagtatttgactagtttattacttgtacagtcaagacgtaaaccaacggtcggtcttcctcgtttacgggccgggtaacgggacccaaggggtcggaagtatacgaaaccggtaatgggttaggccttggacctacagttcttcgtcttcctaacttcctcccgctcttccgttg

SEQ ID NO: 376911 - DNA, 518 bp, Homo sapiens
  misc_feature: GZ8MTXP01EGTXV.51.23.C01.1.454.CMB.2.raw
  modified_base (498)..(498): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaaggtcgttggcatcccagcccaggttcagtgcagtggtctgggacagatcaactctcacatcacagactagagcctgaatatttgctagtttattactgtcagcagcgtaacaacgtggctcttcgttcggcgagggaccaaggtggagatcaaacgtaactggttaggcttgcaccagttcttgtcttnaacttctcccgctaattctg

SEQ ID NO: 376912 - DNA, 535 bp, Homo sapiens
  misc_feature: GZ8MTXP01DBWFK.51.23.C01.1.454.CMB.2.raw
  modified_base (202)..(202): a, c, t, g, unknown or other
  modified_base (262)..(262): a, c, t, g, unknown or other
  modified_base (394)..(394): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagcccaccctctcctgcagggccagtgagagtatgacatcttcttggcctggtaccaaanagaaacctggccaggctccccgactcctcatttatgatgcataccaaaaggtcgttggcatcccagccaggtcagtggcagtggtcctgggacagaattcaactctcacatcacagactagagctagaagtntttgctagtttattactgtcagcagtacgtaaacaacgtggctctcgtttcggacggacgggaccaaagggtgagatacgaaaagaacgtagttggcttgcaccattcttgtcttcaacttctcccgcctaattccttaag

SEQ ID NO: 376913 - DNA, 533 bp, Homo sapiens
  misc_feature: GZ8MTXP01BV6M8.51.23.C01.1.454.CMB.2.raw
  modified_base (203)..(203): a, c, t, g, unknown or other
  modified_base (261)..(261): a, c, t, g, unknown or other
  modified_base (278)..(278): a, c, t, g, unknown or other
  modified_base (352)..(352): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaangccaccctctcctgcagggccagtgagagtattgacatcttctggcctggtaaccaanagaaacctggccaggcnccccgactcctcatttatgatgcatccaaaaggtcgttggcatcccagccaggttcagtggcagtggtctgganagaatcaactctcaccatcaccagactagacgcctgaagtatttgctagtttattacttgtcagcaagacgtaaacacgtaggcttctcgtttcggcggtagggaccaaggtggagacgtacaaacgaactaggttgacttgcctacattcttgtctcaacttctccgcctaattcgtaag

SEQ ID NO: 376914 - DNA, 546 bp, Homo sapiens
  misc_feature: GZ8MTXP01AQ4XI.51.23.C01.1.454.CMB.2.raw
  modified_base (202)..(202): a, c, t, g, unknown or other
  modified_base (501)..(501): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccacctctcctgcagggccagtgagagtattgacatcttctggcctggtaccaacagaaacctggccaggcctccccgactcctcatttatgatgcataccgaaaagggtcgttggcactcccagccaggttcagtggcaggtggtcctgggacagaattcaactctcaccatcaccagactagacgcctagaagtatttgactagtttatactgtcagcagacgtaacaacgtggcttcgtcgttacggcggaggaccgaagggtcggagatacgaaacgaacgtgttaggcttgcnccagttcttcttccttcaacttcccttcccgcctaacgttctaag

SEQ ID NO: 376915 - DNA, 591 bp, Homo sapiens
  misc_feature: GZ8MTXP01EDYR5.51.23.C01.1.454.CMB.2.raw
  modified_base (202)..(202): a, c, t, g, unknown or other
  modified_base (277)..(277): a, c, t, g, unknown or other
  modified_base (357)..(357): a, c, t, g, unknown or other
  modified_base (398)..(398): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagatattgacatcttcttggcctggtaccaacagaaacctggccaggccnccccgactcctctatttatgatgcataccgaaaaggtcgttgcatcccagcccaggttcgagtcggcaggtcgggtcccnggggacaggaattccaactctcacactcaccagactagacnctagagttattgactagtttatacttgtacaggcagtactaacaacggtcgtccttcttcggttcggacggtacgggaccgaaagggttggaagtaacgtacgaaaacgtaaccgttggaggtccttaggcctaaccgttagttccttcggttaacttcctaacgttcccctcccgacctaacgttccgtaag

SEQ ID NO: 376916 - DNA, 589 bp, Homo sapiens
  misc_feature: GZ8MTXP01EOC9C.51.23.C01.1.454.CMB.2.raw
  modified_base (281)..(281): a, c, t, g, unknown or other
tcagcgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaaacagaaacctggccaggccnccccgactcctcatttatgatgcataccgaaaagggtcgttggcatcccagccaggttcagtgcaggtgggtctgggacagaatcaactctcacatcacagacagacgcctagaagtagtttgacttagttttaattactgtcagtcagtactaaacaacgttcggtcttcgttcgtttcgggccgggaacggggaaccgaaagggttggaagtaacgtaccgaaaacgtaaacgttggttgggacgttcggacctaaccttattcttagttccttctaacttcccttcccgctaacttcgttaacgg

SEQ ID NO: 376917 - DNA, 615 bp, Homo sapiens
  misc_feature: GZ8MTXP01EV6AB.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccacctctcctgcagggccagtgagagtattgactattcttcgttggcctaggtaacccaaacagaaacctggccaaggcctccccgactcctctatttatgatgcatccgaaaagggtcgttgcactccagccaggttcagtgcgagtggtctgggacagtatcaactctcacatcacagactagagctagaatatttgactagtttattactgtacagcagacgtaacaacggtggtaccttcgttccgtttcgggaccgggtaacgggtaccgaaaggggtcggaagtacgttaaccgaaaacggtaacgttcggttacgggacttacggaccgtaaccttaacttcggttcgttcctttaccgtaactttccccggttaccccgacccttaacgttcccgtttaaggg

SEQ ID NO: 376918 - DNA, 749 bp, Homo sapiens
  misc_feature: GZ8MTXP01BMIHY.51.23.C01.1.454.CMB.2.raw
  modified_base (204)..(204): a, c, t, g, unknown or other
  modified_base (241)..(241): a, c, t, g, unknown or other
  modified_base (263)..(263): a, c, t, g, unknown or other
  modified_base (282)..(282): a, c, t, g, unknown or other
  modified_base (301)..(301): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagngccaccctctcctgcagggccagtgagagtattgacnttcttctggcctggtaccaaanagaaacctggccacggccnccccgactcctctatttangatgcagtaccgaaaagggtcgttggcactcccgagccgtaggttacgaggtcggcgaggttcggggtccgtaggggacaaggtaactttccaaccttactccaccctaacgttacccaaaccgaacgtaacgtacggtaacgcccgttaaggtaaagtttacttttcggacgttaaaggtttttaacttaacgttcgttaccgtaagaccgtaaaggtaaccgtaaacgtaacgggttgggttcccgttaccgtttccgggtttaccgggggaccggggtaacggggtaaccggtaaaggggtcgggtaaacggtaacgttaaaccgaaaacgggtaacccgttgggttacggggaccttacgggaaccctacgttaccttcgtttacgttccctttaccgtaaccgtttccccttacccccggttacttaacgttcccgtttaagg

SEQ ID NO: 376919 - DNA, 705 bp, Homo sapiens
  misc_feature: GZ8MTXP01BSR26.51.23.C01.1.454.CMB.2.raw
  modified_base (204)..(204): a, c, t, g, unknown or other
  modified_base (289)..(289): a, c, t, g, unknown or other
  modified_base (308)..(308): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaaggggaaancgccaccctctcctgcgagggccagtgagagtattgactatcttcgttcggcctggtaacccaaacacgaaacctggccaggccnccccgactcctctatttangatgcataccgaaaagggttcgttggcactcccagccctaggttccagttggcgaggttgggtccgtggggacaggtaactttcaaaccttctccaaccactccaccagactagactcctagaattatttgacttagttttattacgttgtactaggactacggtacgtaaacgtaacggttcggtccgttccgttcgggtttccggggaaccggggtaacgggggtaaacccgtaaagggggttagggaacgtaacgttaaaccggaaaaccggttaaacgtgggttaacgggccgttacgggacccgtaaacccgttacttccgtttcggttaaccctttaccctaacgttttcccccgttaccccggttaccctaaccggtttccgttaaccgg

SEQ ID NO: 376920 - DNA, 596 bp, Homo sapiens
  misc_feature: GZ8MTXP01BBXOT.51.23.C01.1.454.CMB.2.raw
  modified_base (204)..(204): a, c, t, g, unknown or other
  modified_base (280)..(280): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagngcccaccctctcctgcagggccagtgagagtattgacatcttcttggcctggtaccaacagaaacctggccaggcnccccgactcctcatttatgatgcataccgaaaaggtcgttggcatcccagccaggttcagtgcagtggtctgggacagaatcaactctcacatcaccagactagacgcctagaagtatttgactagtttactatgtcagtcagacgtaacacgtggcttaccgtcgtttcgggcgggtaagggaccgtaaagggttggaagtaactaaccgaaaacggaaccgttggttcgggacttcggacctaaacccgttcgttccgttacgttccttaccgtaaccgttccccgttccccgttaccttaacgttccgtaacg

SEQ ID NO: 376921 - DNA, 693 bp, Homo sapiens
  misc_feature: GZ8MTXP01DLUQP.51.23.C01.1.454.CMB.2.raw
  modified_base (198)..(198): a, c, t, g, unknown or other
  modified_base (302)..(302): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctccagataccatcggggaaactgtgttgacacagtctccagccacctgtcttgtctccgagggaangccacctctctgcagggccagtgagtagtattgactattcttcgttcggcctacggtaaccaaacagaaacctggccacggccctccccgactcctctatttangtatcgctaacgtaccgaaaagggtcgttcggactactccccgagcccgttaggttaccgaggttcggacgtagggttcggggtaccgtgggggaacaggttaaacttcctaacctacctcaacctaactacccaactaacgacgttagggacgtccgtaggtaagttacgttttagcgttaaagttttacttacgttgactagtacgaacgtaacgtaaacctaacggttcgggtacctttccgttaccggtttcggggaccggggtaacggtaccggtaaaggggtggtaaaggtaacctaacggtaaacgaagttcgggttggtacggttcgacgtaacgttcgttcttcgtaaccttctaactttcccgtccgactcttcgttaacg

SEQ ID NO: 376922 - DNA, 602 bp, Homo sapiens
  misc_feature: GZ8MTXP01AOD19.51.23.C01.1.454.CMB.2.raw
  modified_base (201)..(201): a, c, t, g, unknown or other
  modified_base (273)..(273): a, c, t, g, unknown or other
  modified_base (291)..(291): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaangccaccctctcctgcagggccagtgagagtatgacatcttctggcctggtaccaacagaacctggccaggcnccccgactcctcatttangatgcataccgaaaggtcgttggcatcccagcccaggttcaggtgcaggtggtcctgggacagattcgaactctcacatcaccagactagacgcctagaaagtattttgacttaaggttttaacttacgtgtacagtcaagtacgtaaactaacgtggtccttcgttccggtttcgggacgggtacgggaaccgtaaaggggtggaacgtacgtaacgaaaccggtaacgtggttcgggtacttcggacctaccttattccgttgttcccttcgtaaccttcccttccccggacctaacgttcgttaacgg

SEQ ID NO: 376923 - DNA, 523 bp, Homo sapiens
  misc_feature: GZ8MTXP01ANYJ6.51.23.C01.1.454.CMB.2.raw
  modified_base (203)..(203): a, c, t, g, unknown or other
  modified_base (261)..(261): a, c, t, g, unknown or other
  modified_base (279)..(279): a, c, t, g, unknown or other
  modified_base (384)..(384): a, c, t, g, unknown or other
  modified_base (494)..(494): a, c, t, g, unknown or other
  modified_base (506)..(506): a, c, t, g, unknown or other
  modified_base (515)..(515): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaanagccaccctctcctgcagggccagtgagagtattgacatcttctggcctggtaccaanagaaacctggccaggccnccccgactcctcatttactgatgcatccgaaaagggtcgttgcatcccagccagttcagtgcagtggtctgggacagatcaactctcaccatcaccagactagancctagaagtatttgactagtttattactgtcagtcagactaacaacgtcggtcttctcgtttcggcggtaggaccgaaggtggagatacgaaagaactgaggcttgcacnttcttcgtctcnctccgtccnctcttctg

SEQ ID NO: 376924 - DNA, 750 bp, Homo sapiens
  misc_feature: GZ8MTXP01DFRFM.51.23.C01.1.454.CMB.2.raw
  modified_base (203)..(203): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaangcccacctctcctgcagggccagtgagagtattgactatcttcttggcctaggtaccaaacagaaacctggccaggctccccgactcctctatttatgatgacataccgaaaagggtcgttcggcactcccagccctaggttcaggttcggactaggtcggggtcctagggggactaggtaaacttccaaacctctcaaccctataccaaccgacgtaacgtaagacgccgttaagaacgttagttttggactttaaggttttaactttaccgttagttaccgaagttacgaacggtaaccgttaaaccgtaaacggttcggggtacctttccgttaccgggttttacggggaccgggggtaacggggtaacccgtaaaagggggttcggaaacggtaacgtaaccggtaaaaaccggtaacggtttacgggttacgggtacccgttcgggtaacccgtaccccttaaagtttccggttaccgttttaacctttacccgtaactttccccgttacccccggttacgttaacttcccggtttaacggg

SEQ ID NO: 376925 - DNA, 583 bp, Homo sapiens
  misc_feature: GZ8MTXP01DZFGY.51.23.C01.1.454.CMB.2.raw
  modified_base (357)..(357): a, c, t, g, unknown or other
  modified_base (362)..(362): a, c, t, g, unknown or other
  modified_base (374)..(374): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagcccaccctctcctgcagggccagtgagagtattgacattcttcttggcctggtaaccaaacagaaacctggccaggcctccccgactcctcatttatgatgcataccgaaaaggtcgttggcactcccagcccaggttcagtgcagtgggtcnggganagaattcaactntcaccatacacagactagagcctagaagtatttgctagtttagttactgtcagactagacgtaaacaacgtggtcttacgttcgtttagggccggagggaaccaaagggttggtaaggaactacgaaaccgaagtgggagacgttgaccaccttattccgttcgttccttacgtaacctttcctccccgttacctaacgtttcctaagg

SEQ ID NO: 376926 - DNA, 600 bp, Homo sapiens
  misc_feature: GZ8MTXP01EOQG2.51.23.C01.1.454.CMB.2.raw
  modified_base (304)..(304): a, c, t, g, unknown or other
  modified_base (417)..(417): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagagccaccctctcctgcacgggccagtgagagtattgacatcttcgttggcctggtaaccaaacagaaacctggccaggcctccccgactcctctaatttangatgcataccgaaagggtcgtggcatcccagcctaggttcagtggcaggtggtcgtgggacagacttcgaactctcacctactaccacctagactagaacgcctagtaaagtnttttcgacttagttttaacttacttgtacagcaagacgttaaacaacggtgtactcgttcgttcggggcgggtacggacgtaaaggggtgtaaggacttaacgaaacgtaacgtgggttagacgttcgactaacccttgttccttgtaacttctaacgttccctacccgctaacgttcgtaag

SEQ ID NO: 376927 - DNA, 517 bp, Homo sapiens
  misc_feature: GZ8MTXP01E4TNI.51.23.C01.1.454.CMB.2.raw
  modified_base (202)..(202): a, c, t, g, unknown or other
  modified_base (382)..(382): a, c, t, g, unknown or other
  modified_base (493)..(493): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccacctctcctgcagggccagtgagagtatgacatcttcttggcctggtaccaacagaaacctggccaggctccccgactcctcatttatgatgcatccaaaagggtcgttggcatcccagccaggtcagtgcagtggtcctggggacagaattcaactctcaccatcacagactagancctgaagtatttgcagttttatactgtcagcagcgtaaacaacgtggctcttctttcggcgggagggtaccgaaggtggagatacgaaagaactgttggcttgcacattcngtctcaatcctccgctaattctcg

SEQ ID NO: 376928 - DNA, 543 bp, Homo sapiens
  misc_feature: GZ8MTXP01BNMBA.51.23.C01.1.454.CMB.2.raw
  modified_base (202)..(202): a, c, t, g, unknown or other
  modified_base (276)..(276): a, c, t, g, unknown or other
  modified_base (371)..(371): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttcacacagtctccagccaccctgtctttgtctccaggggaaangccaccctctcctgcagggccagtgagagtattgacatcttctggcctggtaccaacagaaacctggccaggcnccccgactcctcatttatgatgcatccaaaagggtcttggcatcccagccaggttcagttggcaggtggtcctgggacagattcaactctcaccntcaccagactagacgcctgaagtattttgacttagtttacttactgtcagcagacgtaacaacgtggtctctcgtttcggcggagggaccaagggtggtagatacgaaacggaacgtggttggcttgcaccgattcgttctccttcaacttccctcccgcctaacttcgtcg

SEQ ID NO: 376929 - DNA, 585 bp, Homo sapiens
  misc_feature: GZ8MTXP01EIBQY.51.23.C01.1.454.CMB.2.raw
  modified_base (304)..(304): a, c, t, g, unknown or other
  modified_base (357)..(357): a, c, t, g, unknown or other
  modified_base (375)..(375): a, c, t, g, unknown or other
  modified_base (386)..(386): a, c, t, g, unknown or other
  modified_base (394)..(394): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagacgccaccctctcctgcagggccagtgagagtattgactatcttcgttcggcctggtacccaaacagaaacctggccaggcctccccgactcctcatttangatgcataccgaaaggtcgttggcactccagccaggttcagtgcaggtggtcngggacagattcaaactcncacatcacganactagacnctagaagtatttgctagtttaattactgtacagtacagtacgtaaactaacggtcggtcttcgttcggtttacgggaccggtaagggacccgtaaagggtggaacgtaagtaccgaaacgaacgttggttacgacttcggaacacttagttcttagttccttgtaactccgttacccgctaattccgtaag

SEQ ID NO: 376930 - DNA, 557 bp, Homo sapiens
  misc_feature: GZ8MTXP01AX3R8.51.23.C01.1.454.CMB.2.raw
  modified_base (280)..(280): a, c, t, g, unknown or other
  modified_base (298)..(298): a, c, t, g, unknown or other
  modified_base (521)..(521): a, c, t, g, unknown or other
  modified_base (531)..(531): a, c, t, g, unknown or other
  modified_base (534)..(534): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaaacagaaacctggccaggccnccccgactcctcatttangatgcatccgaaaaggtcgttggcacgtccagtcccaggttccaggttggcaggtggtccgtgggacagtaattcaactctcaccatcaccagactagacgtccgtagaacgtatttgacttaagttttatacgttagtcagtacagtacgtaacacggttcggtcttacgtcgttcgggacgaggacgaggtgatagacaacgtaatgttggcttgcaccgnttcgttcgtntcncttctcccgactaattcgtaacg

SEQ ID NO: 376931 - DNA, 691 bp, Homo sapiens
  misc_feature: GZ8MTXP01DO50K.51.23.C01.1.454.CMB.2.raw
  modified_base (202)..(202): a, c, t, g, unknown or other
tcagcgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccacctgtctttgtctccaggggaaangccaccctctcctgcagggccagtgagagtattagactatcttcgttggtcctagggtaaccaaacagaaacctggccaggcctccccgactcctctaatttactgatcgcataccgaaaaggtcgttcggcactccccagccgtaggtcgagtcggcgtaggtgggtcgtgggaactaggtaacttcaacgtctcaccataccgaacaacgactacgactacctgtaaacgtatttgacttagtttaacttacttgttacagactaacggtaactaaacgtaacggtacggtcttccgttcgttacgggacggggtacgggaacccggtaaaggggttacggaaggtaaacgttaaccgaaaacggttaaacgttcgggttacgggtacgttacggacctaacccggttattcccgttagggttttccctttacccgtaacttttccccggttacccccgttaccttaaccgttccgtttaaaccggg

SEQ ID NO: 376932 - DNA, 529 bp, Homo sapiens
  misc_feature: GZ8MTXP02H5JUQ.51.23.C01.1.454.CMB.2.raw
  modified_base (203)..(203): a, c, t, g, unknown or other
  modified_base (369)..(369): a, c, t, g, unknown or other
  modified_base (430)..(430): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagngccaccctctcctgcagggccagtgagagtattgacatcttcttggcctggtaccaacagaaacctggccaggctccccgactcctcattatgatgcatccaaaagggtcgttggcatcccagccaggttcagtggcagtgggtcctggggacagaattcactctnaccatccaccagactagagcctgaagtattttgcagtttattactgtcagtcagcgtaaanaactggctctctttcggcggtagggaccaaggtggagatacgaaaacgaactagtggactggactaccactctgtcttcactccttccgcctactcctg

SEQ ID NO: 376933 - DNA, 519 bp, Homo sapiens
  misc_feature: GZ8MTXP02G4QEY.51.23.C01.1.454.CMB.2.raw
  modified_base (202)..(202): a, c, t, g, unknown or other
  modified_base (511)..(511): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaacctggccaggctccccgactcctcatttatgatgcatccaaaagggtcttggcatcccagccaggttcagtgcagtggtcctgggacagaattcactctcaccatcaccagactagagcctgaagtatttgctagtttattactgtcagcagcgtaaacaactggctctctttcggcggtagggaccaagggtggagatacgaaaacgtactagtgctgacaccatcctagtcttcactctacccncactctag

SEQ ID NO: 376934 - DNA, 523 bp, Homo sapiens
  misc_feature: GZ8MTXP02GGFW9.51.23.C01.1.454.CMB.2.raw
  modified_base (202)..(202): a, c, t, g, unknown or other
  modified_base (261)..(261): a, c, t, g, unknown or other
  modified_base (428)..(428): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaanagaaacctggccaggctccccgactcctcatttatgatgcatccaaaagggtcttggcatcccagccaggttcagtggcagtgggtcctggggacagaattcactctcaccatcaccagactagagcctgaagtattttgctagtttatactgtcagcagacgtaanaactggactctcgtttcggacggtaggaccaggtggagatcgaaaacgaactgtaggctgacaccatctgtcttcacttcttcccgctactctcg

SEQ ID NO: 376935 - DNA, 556 bp, Homo sapiens
  misc_feature: GZ8MTXP02HZQ29.51.23.C01.1.454.CMB.2.raw
  modified_base (200)..(200): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctcaggggaaangccacctctcctgcagggccagtgagagtattgacatcttcttggcctggtaccaacagaaacctggccaggctccccgactcctcatttatgatgcatccaaaagggtcgttggcatcccagccaggttcagtgcagtggtcctgggacagaattcactctcaccatcaccagactagagcctagaagtatttgctagttttattacttgtctagcagacgttaaacaacttaggctctcgtttcggacggagggaccgtaaggtcgggagaagtacgaaaacgtaactaggtagggccttggacctacccaattcctagtcctttcaacttccttacccgcctacttccgtacg

SEQ ID NO: 376936 - DNA, 529 bp, Homo sapiens
  misc_feature: GZ8MTXP02GRTBI.51.23.C01.1.454.CMB.2.raw
  modified_base (201)..(201): a, c, t, g, unknown or other
  modified_base (259)..(259): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctcaggggaaanagccacctctcctgcagggccagtgagagtattgacatcttcttggcctggtaccaanagaaacctggccaggctccccgactcctcattatgatgcatccaaaagggtcgttggcatcccagccaggttcagtggcaggtggtcctgggacagaattcactctcaccatcaccagactagacgcctgaaagtattttgctaagtttatactgtcagacagacgtaaacaactggctcttcgttggacggaggaccaaagggtggaagatacaaaacggaactgtggctagccaccatctagtccttcacttccttcccgcactctag

SEQ ID NO: 376937 - DNA, 512 bp, Homo sapiens
  misc_feature: GZ8MTXP02JXUZI.51.23.C01.1.454.CMB.2.raw
  modified_base (201)..(201): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaanagccaccctctcctgcagggccagtgagagtattgacatcttcttggcctggtaccaacagaaacctggccaggctccccgactcctcatttatgatgcatccaaaagggtcgttggcatcccagccaggttcagtggcagtggtcctggggacagaattcactctcaccatcaccagactagagcctgaagatttgctagtttatactgtcagcagcgtaacactggctctctttcggcggagggaccaagggtggagatcgaaacgactgtagctgcaccatctgtcttcatccttccgcctactctcg

SEQ ID NO: 376938 - DNA, 510 bp, Homo sapiens
  misc_feature: GZ8MTXP02H71CS.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccacctctcctgcagggccagtgagagtattgacatcttcttggcctggtaccaacagaaacctggccaggctccccgactcctcatttatgatgcatccaaaagggtcgttggcatccagccaggttcagtgcagtggtcctgggacagaattcactctcaccatcaccagactagagcctgaagtatttgcagtttattactgtcagcagacgtaacaaactggctctctttcggcggtagggaccaagggtggagatcaaaacgaactgtaggctgcaccatctgtctcatcttccgcatctag

SEQ ID NO: 376939 - DNA, 526 bp, Homo sapiens
  misc_feature: GZ8MTXP02H0BP9.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaacagaaaacctggccaggcctccccgactcctcattatgatgcatccaaaagggtcgttggcatcccagccaggttcagtgcagtgggtcctggggacagaattcactctcacatcaccagactagagcctgaagatttgctagtttattactgtcagcagacgtaacaactggactctcgtttcggcggagggaccaagggtggaagatacaaaacgactagtggctgcaccatttgacttctactttcccgctactctagtatcg

SEQ ID NO: 376940 - DNA, 526 bp, Homo sapiens
  misc_feature: GZ8MTXP02GWNZA.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaacagaaacctggccaggctccccgactcctcatttatgatgcatccaaaagggtcgttggcatcccagccaggttcagtggcagtggtcctgggacagaattcactctcaccatcaccagactagagcctgaagattttgctagtttattactgtcagcagacgtaacaaactggactcttcgtttcggcggtacgggaccgaagggtggacgatacgaaaacgtacgtagtggctggcacatctgtctcatcctccgctactctag

SEQ ID NO: 376941 - DNA, 561 bp, Homo sapiens
  misc_feature: GZ8MTXP02G06WK.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaanagccacctctcctgcagggccagtgagagtattgacatcttctggcctggtaccaacagaaacctggccaggcctccccgactcctcatttatgatgcataccgaaaagggtcgttggcactcccagcctaggttcaggtggcaggtgggtcctggggacagtaatcactctcacatcaccagactagacgcctagaagtattttgcttaagttttattacgtgtacagcagtacgtaaacaacgtggacttcgttcgtttcgggacggtacgggaaccgtagggtggagacgtacgaaaacgtaacgtggtacggctagccaccatcgtgtccttcacttccttcccgctactacgtg

SEQ ID NO: 376942 - DNA, 506 bp, Homo sapiens
  misc_feature: GZ8MTXP02JWOE2.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttctggcctggtaccaacagaaacctggccaggctccccgactcctcatttatgatgcatccaaaagggtcttggcatccagccaggttcagtgcagtggtcctgggacagaattcactctcaccatcaccagactagacgcctgaagatttgctagtttatactgtcagcagcgtaacaactggctctctttcggcggaggaccaagggtgagatacaaagaactgtaggctgcacatctgtcttcactcttccgctactctag

SEQ ID NO: 376943 - DNA, 518 bp, Homo sapiens
  misc_feature: GZ8MTXP02FP5O3.51.23.C01.1.454.CMB.2.raw
  modified_base (202)..(202): a, c, t, g, unknown or other
  modified_base (260)..(260): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaanagaaacctggccaggctccccgactcctcatttatgatgcatccaaaaggtcgttggcatcccagccaggtcagtgcagtggtctgggacagaattcactctcaccatcaccagactagagcctgaagtatttgctagtttatactgtcagcagacgtaaacaaactggactcttctttcggacgtagggaccaagggtgagagtacaaaacgaactgaggctagcaccatctgtcttcactcctcccgcactctacg

SEQ ID NO: 376944 - DNA, 516 bp, Homo sapiens
  misc_feature: GZ8MTXP02JH69J.51.23.C01.1.454.CMB.2.raw
  modified_base (202)..(202): a, c, t, g, unknown or other
  modified_base (261)..(261): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaanagaaacctggccaggctccccgactcctcatttatgatgcatccaaaagggtcgttggcatccagccaggttcagtgcagtggtcctgggacagaattcactctcaccatcaccagactagagcctgaagtattttgctagtttattactgtcagtcagcgtaacaactggactctctttcggcggtagggaccaagggtggagatacaaacgaactgtaggctgcaccatctgtctcactctccgctactctag

SEQ ID NO: 376945 - DNA, 516 bp, Homo sapiens
  misc_feature: GZ8MTXP02FYQKA.51.23.C01.1.454.CMB.2.raw
  modified_base (202)..(202): a, c, t, g, unknown or other
  modified_base (261)..(261): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaanagaaacctggccaggcctccccgactcctcatttatgatgcatccaaaagggtcttggcatcccagcccaggttcagtgcagtggtcctgggacagaattcactctcaccatcaccagactagagctgaagatttgctagtttatactgtcagcagcgtaaacaactggctctcgtttcggcggagggaccaaggtggaagatacaaaacgaactgtggctggcaccatctgtcttctactcttcctccactctg

SEQ ID NO: 376946 - DNA, 516 bp, Homo sapiens
  misc_feature: GZ8MTXP02JBX0C.51.23.C01.1.454.CMB.2.raw
  modified_base (200)..(200): a, c, t, g, unknown or other
  modified_base (257)..(257): a, c, t, g, unknown or other
  modified_base (292)..(292): a, c, t, g, unknown or other
  modified_base (378)..(378): a, c, t, g, unknown or other
  modified_base (507)..(507): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccaggggaangccacctctcctgcagggccagtgagagtattgacatcttcttggcctggtaccaanagaaacctggccaggctccccgactcctcatttangatgcatccaaaagggtcttggcatccagcctaggttcagtgcagtggtctgggacagaattcactctcacatcaccagactagancctgaagtatttgctagtttatactgtcagcagacgtaacaaacgtggtactcttctttacggcggtacgggaccaaggtggagatcaaacgaactgtggctgcacactctcgtaactcactccttccnctactctag

SEQ ID NO: 376947 - DNA, 533 bp, Homo sapiens
  misc_feature: GZ8MTXP02GLYAB.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaacagaaacctggccaggctccccgactcctcatttatgatgcatccaaaagggtcgttggcatcccagccaggttcagtgcagtggtctgggacagattcactctcaccatcaccagactagacgcctgaagtatttgctagtttattactgtcagcagacgtaaacaacgtggtactcttcgtttcggcggtagggaccgtaagggtggagatacgaaaacgtaacgtggtagctagcacgatctgtccttcactccttcccgctactctacg

SEQ ID NO: 376948 - DNA, 528 bp, Homo sapiens
  misc_feature: GZ8MTXP02H9GGS.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagcccaccctctcctgcagggccagtgagagtattgacatcttcttggcctggtaccaacagaaacctggccaggcctccccgactcctcatttatgatgcataccgaaaagggtcgttggcatcccagcaggttcagtgcagtggcctgggacagattcactctcacatcacagactagagcctagaaagtattttgactagtttattactgtacagtcagacgtaacaactggactctcgttcggcggtaggaccgaaggtggaagatacgaaaacgtacagtggctggacacctactctgtcttcacttcttccgcctatctg

SEQ ID NO: 376949 - DNA, 523 bp, Homo sapiens
  misc_feature: GZ8MTXP02H0ZGG.51.23.C01.1.454.CMB.2.raw
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccacctctcctgcagggccagtgagagtattgacatcttcttggcctggtaccaacagaaacctggccaggctccccgactcctcatttatgatgcatccaaaagggtcgttggcatcccagccaggttcagtggcagtggtctgggacagaattcactctcaccatcaccagactagagcctgaagatttgcagtttattactgtcagcagacgttaacaactggcttctctttcggcggtagggaccaagggtaggagatacgaaaacgtaactgtaggctggacaccaatctgtcttcactcttacccgctatctg

SEQ ID NO: 376950 - DNA, 522 bp, Homo sapiens
  misc_feature: GZ8MTXP02J1OL8.51.23.C01.1.454.CMB.2.raw
  modified_base (201)..(201): a, c, t, g, unknown or other
  modified_base (367)..(367): a, c, t, g, unknown or other
  modified_base (482)..(482): a, c, t, g, unknown or other
  modified_base (485)..(485): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggccccagataccatcggggaaactgtgttgacacagtctccagccaccctgtctttgtctccaggggaaanagccaccctctcctgcagggccagtgagagtattgacatcttcttggcctggtaccaacagaaacctggccaggctccccgactcctcattatgatgcatccaaaagggtcgttggcatcccagccaggttcagtggcagtgggtctgggacagaattcactctcnccatcaccagactagagcctgaagtattttgctagtttattactgtcagcagcgtaacaactggctctctttcgggcggagggaccaaagggtggaggatcaaaacgaacttggngcncgcacactctgtctctacttcctccgctactctatcg

SEQ ID NO: 376951 - DNA, 518 bp, Homo sapiens
  misc_feature: GZ8MTXP02JHKIK.51.23.C01.1.454.CMB.2.raw
  modified_base (202)..(202): a, c, t, g, unknown or other
  modified_base (261)..(261): a, c, t, g, unknown or other
  modified_base (510)..(510): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaanagaaacctggccaggctccccgactcctcatttatgatgcatccaaaagggtcgttggcatcccagcccaggttcagtgcagtggtcctgggacagaattcactctcaccatcaccagactagagcctgaagtatttgctagtttatactgtcagcagcgtaaacaactggctctctttcggcggtagggaccaaggtggagatacgaaaacgaactgtggctgcacatctgtcttcactcgttccccnctactctg

SEQ ID NO: 376952 - DNA, 514 bp, Homo sapiens
  misc_feature: GZ8MTXP02GBJS6.51.23.C01.1.454.CMB.2.raw
  modified_base (202)..(202): a, c, t, g, unknown or other
  modified_base (260)..(260): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccacctctcctgcagggccagtgagagtattgacatcttcttggcctggtaccaanagaaacctggccaggctccccgactcctcatttatgatgcatccaaaagggtcgttggcatcccagccaggttcagtgcagtggtcctgggacagaattcactctcaccatcaccagactagagcctgaaagattttgctagtttatactgtcagcagcgtaaacaactggctctctttcggcggagggaccaaggtgagatcaaaacgactagtggctggctaccatctgtcttcactcttcccgcactctag

SEQ ID NO: 376953 - DNA, 531 bp, Homo sapiens
  misc_feature: GZ8MTXP02HBFZG.51.23.C01.1.454.CMB.2.raw
  modified_base (202)..(202): a, c, t, g, unknown or other
  modified_base (258)..(258): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttctggcctggtaccanagaactgcaggctcccgactcctcatttatgatgcatccaaaagggtcgttggcatcccagccaggttcagtggcaggtggtcctgggacagattcactctcaccatcaccagactagacgcctgaagtatttgactagtttattactgttacagcagacgtaaacaactggactctcgtttcggcggagggaccaagggtggagagtacgaaacgtaacgtggtggctggacacctatcgttgtcttctacttccttccgcctactccttag

SEQ ID NO: 376954 - DNA, 607 bp, Homo sapiens
  misc_feature: GZ8MTXP02HME6U.51.23.C01.1.454.CMB.2.raw
  modified_base (202)..(202): a, c, t, g, unknown or other
  modified_base (211)..(211): a, c, t, g, unknown or other
  modified_base (258)..(258): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctntcctgcagggccagtgagagtatgacatcttctggcctggtaccaanagaaacctggccaggcctccccgactcctcatttatgatgcataccgaaaagggtcgttggcatcccagccaggtcagtggcaggtggtctgggacagtaatcactctcaccatcacagactagagcctagaagtatttgactagtttattactgtactagcagacgtaaactaacgtggtaccttcttccgtttacgggcgggaacggggtaccgaaagggttgggaacgtacgtaacgaaaacggtaaccgtaggtcgggtacttacggaccctacgtaacgttccttaggttcctttaccgtaacgtttcccctttcccccggacccttaacgttacccgtttcgg

SEQ ID NO: 376955 - DNA, 533 bp, Homo sapiens
  misc_feature: GZ8MTXP02GVI7O.51.23.C01.1.454.CMB.2.raw
  modified_base (202)..(202): a, c, t, g, unknown or other
  modified_base (261)..(261): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaanagaaacctggccaggctccccgactcctcactttatgatgcatccaaaagggtcgttggcatcccagccaggtcagtggcagtggtcctgggacagaattcgactctcaccatcaccagactagagcctgaacgtatttgactagtttattactgtacagtcagacgtaaacaactggacttctcgtttcggcggaggaccgaagggtcggagagtacaaaacgtaactgtggactggcacatctgtcttcacttcttacccgctactctag

SEQ ID NO: 376956 - DNA, 541 bp, Homo sapiens
  misc_feature: GZ8MTXP02IA2GQ.51.23.C01.1.454.CMB.2.raw
  modified_base (202)..(202): a, c, t, g, unknown or other
  modified_base (363)..(363): a, c, t, g, unknown or other
  modified_base (365)..(365): a, c, t, g, unknown or other
  modified_base (380)..(380): a, c, t, g, unknown or other
  modified_base (388)..(388): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagatattgacatcttctggcctggtaaccaacagaaacctggcaggcctccccgactcctcattatgatgcataccgaaaagggtcgttggcatcccagccaggttcagtggtagtggtctgggacagatcactcncncatcacagactagancctagaanattttgcttagttattactgtcagcagacgtaaacacgtaggcttcttcgtttcgggcggtagggaccaagggtggagatacgaaaacgactggtagctagacaactactcctgttacttcgtacttccgttcccgacctactaccgttgacg

SEQ ID NO: 376957 - DNA, 510 bp, Homo sapiens
  misc_feature: GZ8MTXP02I2BF2.51.23.C01.1.454.CMB.2.raw
  modified_base (203)..(203): a, c, t, g, unknown or other
  modified_base (437)..(437): a, c, t, g, unknown or other
  modified_base (447)..(447): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcagggaaactgtgttgacacagtctccagccaccctgtctttgtctccaggggaaagngccaccctctcctgcagggccagtgagagtattgacatcttcttggcctggtaccaacagaacctggccaggctcccgactcctcatttatgatgcatccaaaaggtcgttggcatcccagcaggttcagtgcagtcggtctgggacagaattcactctcaccatcaccagactagagctagaagtatttgctagtttattactgtacagtcagacgtaaacactaggtccttntcgtttcggnggagggacaaggtgagatacaaacgactgcggctagcaccatctgtctcactcttccgcactc

SEQ ID NO: 376958 - DNA, 517 bp, Homo sapiens
  misc_feature: GZ8MTXP02F6TZ9.51.23.C01.1.454.CMB.2.raw
  modified_base (261)..(261): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaanagaaacctggccaggctccccgactcctcatttatgatgcatccaaaagggtcgttggcatcccagcccaggttcagtgcagtgggtctgggacagaattcactctcaccatcaccagactagagcctgaagtatttgctagtttatactgtcagcagcgtaaacaaactggctctctttcggcggtagggaccaaggtggagatcgaaaagaactgtaggctgcaccatctagtcttcactctcccgcactctag

SEQ ID NO: 376959 - DNA, 726 bp, Homo sapiens
  misc_feature: GZ8MTXP02GWB6W.51.23.C01.1.454.CMB.2.raw
  modified_base (202)..(202): a, c, t, g, unknown or other
  modified_base (211)..(211): a, c, t, g, unknown or other
  modified_base (510)..(510): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctntcctgcagggccagtgagagtattgacatcttcttggcctggtaccaaagaacgtacgcgacgacgtccctaccgtcctcctattaactttgagtatcgactaccgtaaaacggggtaaacgggtttcggtcgactacccgtaccgacgtaccggttacggtacgagggtcgacggtaggggttcggtccgggtacggacgtaaagttactacctacttcctaccaactcacccaacgtacgtagacgccttacgaagtaacgttttagtacgtacgtttaaagttttacttaccggtntaccgagtacgacggtaaaccgtaaacgttacgtcggttaccttcgtttcggggtacgggacgggtaaacggacggtaggggacgtaacgtacgtaaaaccgaaacgttaacggtcggtacggtaccgtaacggaccctaaacggttactttccgtttacggttcccgttaacttaccctttcccccggttaaccctcctaaccgtttcgtaacgg

SEQ ID NO: 376960 - DNA, 634 bp, Homo sapiens
  misc_feature: GZ8MTXP02HN2AY.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccgaggggaaanagccaccctctcctgcagggccagtgagagtattgactatcttcgtggcctggtaaccaacagaaacctggccaggcctccccgactcctcatttatgatgcataccgaaaaggtcgtggcactcccagccaggttcaggtggcaggtgggtccgtgggacagtaacttcacttctcaccatccaccagactagacgctagaagtatttagcttaagtttattactgtacagacaacgtacgtaaacctaaacgttcgggtacttccgttacggtttccgggaccggggtaacggggaaccggaaaggggttacgggaaacgtagtaaaccgaaaacggtaacgttaggttacgggacgttacggaccgtaacctaacgttccttcgttaaccgtttctacgtttccccttcccgtacctacgtttcctacg

SEQ ID NO: 376961 - DNA, 605 bp, Homo sapiens
  misc_feature: GZ8MTXP02GG8XR.51.23.C01.1.454.CMB.2.raw
  modified_base (262)..(262): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacattcttcttggcctggtaccaanagaaacctggccaggctccccgactcctcatttatgatgcataccgaaaagggtcgttggcatcccagccaggttcagtgcaggtggcctgggacagattcactctcaccataccaccagactagacgcctagaagtattttgacttaagtttacttacgtgtacagtcaagtaccgtaaacaacgtcggtcttccgttacggtttcgggacggtacggggaaccgtaaggggtacgaaggtaacgtacgaaaacggtaacgtggtacgggtcctacggacctaccacgttccgttgtaaccgtttacacgtttcccttacccccggtctaacttacccgttg

SEQ ID NO: 376962 - DNA, 646 bp, Homo sapiens
  misc_feature: GZ8MTXP02IRODG.51.23.C01.1.454.CMB.2.raw
  modified_base (201)..(201): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaagngccacctctcctgcagggccagtgagagtattgacatcttcttggcctggtaccaacagaaacctggccaggctccccgactcctcatttatgatgcatccaaaagggtcgttggcatcccagccaggttcagtggcagtggtctgggacagaattcactctcaccatcaccagactagagcctgaagtatttgctagtttattactgttcagtcagtacgtaactaacgtggtcttaccgttcgtttaccggggcggggtaacgggggtacccgtaaaagggggttacgggaaggtaaacgttaccggaaaaaaccggtaaaccggttagggttaacggggccgtttacggggaccctacccggtaaacttccgtttacggttcccgtttaccgtaacctttcccgtttaccccggtaccccttacggtttaaccctttaccgg

SEQ ID NO: 376963 - DNA, 522 bp, Homo sapiens
  misc_feature: GZ8MTXP02F78QB.51.23.C01.1.454.CMB.2.raw
  modified_base (261)..(261): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaanagaaacctggccaggctccccgactcctcatttatgatgcatccaaaagggtcgttggcatcccagccaggtcagtgcagtggtctgggacagaattcactctcaccatcaccagactagagcctgaagtatttgctagtttatactgtcagcagacgtaaacaactggtctacttcgtttcggacggagggaccaagggtggagatacaaaacgactgtgctgcacatctagtcttcacttcctcccgactacgtctacg

SEQ ID NO: 376964 - DNA, 526 bp, Homo sapiens
  misc_feature: GZ8MTXP02I0J6W.51.23.C01.1.454.CMB.2.raw
  modified_base (201)..(201): a, c, t, g, unknown or other
  modified_base (287)..(287): a, c, t, g, unknown or other
  modified_base (375)..(375): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaanagccacctctcctgcagggccagtgagagtattgacatcttcttggctggtaccacagaactggcaggctcccgactctcatttangatgcatccaaaagggtcgttggcatcccagccaggttcagtgcaggtggtcctgggacagaattcactctcacatcaccagactagnctgaatatttgctagtttatactgtcagcagtactaacaactggctctcgttcggcggagggaccagggtaggagaagtacaaaacgaacgtggtacgcgtacggcaccgattcttacgtcttcacttcccttacccgacctattacctgg

SEQ ID NO: 376965 - DNA, 620 bp, Homo sapiens
  misc_feature: GZ8MTXP02GVNK4.51.23.C01.1.454.CMB.2.raw
  modified_base (203)..(203): a, c, t, g, unknown or other
  modified_base (212)..(212): a, c, t, g, unknown or other
  modified_base (296)..(296): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggcccccagataccatcggggaaactgtgttgacacagtctccagccaccctgtctttgtctccgaggggaaangccaccctntcctgcagggccagtgagagtattgacatcttctggcctggtaccaacagaaacctggccaggcctccccgactcctctattangatgacataccgaaaagggtcgttggcactcccagcctaggttcagtggcaggtggtctgggacagaacttcgactctcacctatccaccagacctagacgcctagaatatttgacgtatttagttactgttacagacacgtacgtaaacacgtcggtcttcgttacggtttcgggacgggaacgggtaaccgtaaggggtgaaacgacgttaacgaaaacgtaacgtggtacggcttacggacctacctaacggttccttacggtttccttaaccgttaaccgttacccttccccggtacctaactttccgttagttaaccgg

SEQ ID NO: 376966 - DNA, 547 bp, Homo sapiens
  misc_feature: GZ8MTXP02F9U17.51.23.C01.1.454.CMB.2.raw
  modified_base (203)..(203): a, c, t, g, unknown or other
  modified_base (262)..(262): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaanagccaccctctcctgcagggccagtgagagtattgacatcttcttggcctggtaccaanagaaacctggccaggctccccgactcctcatttatgatgcatccgaaaagggtcgttggcatcccagccaggttcagtggcaggtgggtccgtgggacagaattcactctcaccatcaccagactagacgcctagaaagtattttgctagtttattacttgtcagacagacgtaaacaactggacttctacgtttcggacggtagggaaccgagggtggagatacgaaaacgaacgtggtagcgtggcacacgtctgtcttcacttcctacccgctactcgtacg

SEQ ID NO: 376967 - DNA, 590 bp, Homo sapiens
  misc_feature: GZ8MTXP02GV2HC.51.23.C01.1.454.CMB.2.raw
  modified_base (203)..(203): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagngccaccctctcctgcagggccagtgagagtattgacatcttcttggcctggtaccaacagaaacctggccaggctccccgactccctcatttatgatgcatcgaaaaggtcgttggcatcccagccaggttcagtgcgagtggtccgtgggacagaattcactctcaccatccaccagactagacgcctagaagtatttgactagttttattactgtacagtcagactaaacactggtactcgttcgttcggacggtacgggaccgtaagggtacggaagtacgtaacgaaaacgtaacgtcggttaggactacggacctaccgtacttccgttacgtttaaccttaccgtaacgttccccttaccccgacctacgttaccgttacg

SEQ ID NO: 376968 - DNA, 524 bp, Homo sapiens
  misc_feature: GZ8MTXP02HHX9R.51.23.C01.1.454.CMB.2.raw
  modified_base (202)..(202): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttctggcctggtaccaacagaaacctggccaggctccccgactcctcatttatgatgcatccaaaagggtcgttggcatcccagcccaggttcagtgcagtggtctgggacagaattcactctcgccatcaccagactagagcctgaagtatttgctagtttattactgtcagcagcgtaaacaactggctctcgtttcggcggtagggaccaagggtggagatacaaacgaactggtaggctggacaccgatctgtcttcactccttcccgcctactcctg

SEQ ID NO: 376969 - DNA, 527 bp, Homo sapiens
  misc_feature: GZ8MTXP02JCXLK.51.23.C01.1.454.CMB.2.raw
  modified_base (202)..(202): a, c, t, g, unknown or other
  modified_base (296)..(296): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaacagaaacctggccaggctccccgactcctcatttangatgcatccaaaagggtcttggcatccagccaggttcagtgcagtggtctgggacagaattcactctcaccatcaccagactagagcctgaagtatttgctagtttatactgtcagcagacgttaaacaactcggtctcgttcgtttaccggcggaacgggaccgaagggtggagagtacaaaacgaaacgtgtaggctgcaccatcctgtctcatcttaccgctatctag

SEQ ID NO: 376970 - DNA, 591 bp, Homo sapiens
  misc_feature: GZ8MTXP02F8WDM.51.23.C01.1.454.CMB.2.raw
  modified_base (203)..(203): a, c, t, g, unknown or other
  modified_base (260)..(260): a, c, t, g, unknown or other
  modified_base (394)..(394): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaangccacctctcctgcagggccagtgagagtattgacatcttcttggcctggtaccaanagaaacctggccaggctccccgaatcctcatttatgatgcataccaaaagggtcgttggcatcccagccaggttcagtggcagtggtctgggacagatcactctcacatcaccagactagacgacctgaaagtntttaggctaagttttatacttagtcgtagtacagaccggtaaacaaacgttcgggctttcttcggtttccgggacgggtacggggaacctaaggggttaggagaacgtacgaaaaaccggtaactggggtacggacgtaggaccaaccgtactcgtttcgtcgttacaacttcccgtttacccccgactactcgtcg

SEQ ID NO: 376971 - DNA, 538 bp, Homo sapiens
  misc_feature: GZ8MTXP02JSTCD.51.23.C01.1.454.CMB.2.raw
  modified_base (202)..(202): a, c, t, g, unknown or other
  modified_base (261)..(261): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaanagaaacctggccaggctccccgactcctcattatgatgcatccaaaagggtcgttggcatcccagccaggttcagtggcagtggtcctgggacagattcactctcaccatccaccagactagagcctgaagtatttgctagtttatactgtcagcagcgtaaacaactggtactcttcgttacggcggacggaccgaagggtcggagactacgaaaacgtaacgtggtagactcggacacccagtctagtcgttctacttcctcccgacctactctg

SEQ ID NO: 376972 - DNA, 643 bp, Homo sapiens
  misc_feature: GZ8MTXP02H4BS7.51.23.C01.1.454.CMB.2.raw
  modified_base (203)..(203): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagngccaccctctcctgcagggccagtgagagtattgacatcttcttggcctggtaccaacagaaacctggccaggctccccgactcctcattatgatgcatccaaaagggtcgttggcatcccagccaggttcagtgcagtggtcctgggacagaattcactctcaccatccaccagctagagcctgaagatttgctagttttattactgttcagcagacgtaaacaacgttaggcttaccgttcgtttccggggacgggaacggggaacccgtaaagggggttacgggaaggtaacgttaccgaaaaaacggtaaaccgttagggttacggggtccttacgggaacccgtaaccccgtaaactttcccgttaaggtttcccgtttaccgtaaacctttcccgttttaccccccggtaccctaaacctttccccgttaacgg

SEQ ID NO: 376973 - DNA, 535 bp, Homo sapiens
  misc_feature: GZ8MTXP02IMMM9.51.23.C01.1.454.CMB.2.raw
  modified_base (202)..(202): a, c, t, g, unknown or other
  modified_base (379)..(379): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttctggcctggtaccaacagaaacctggccaggcctccccgactcctcattatgatgcatcgaaaagggtcgtggcatcccagccaggttcagtggcaggtggtcctgggacagtaattcactctcaccatcaccanactagagcctagaactatttgcttaagtttattactgtcagcagtacgtaacaacgtggtctcgttcgttacggcggtagggaccaagggtcggaagagtacaaaacgtaacgtggtggactgacaccatctgtctcactccttccgcactctacg

SEQ ID NO: 376974 - DNA, 545 bp, Homo sapiens
  misc_feature: GZ8MTXP02F6FV9.51.23.C01.1.454.CMB.2.raw
  modified_base (202)..(202): a, c, t, g, unknown or other
  modified_base (376)..(376): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaacctggccaggctccccgactcctcatttatgatgcatccaaaagggtcgttggcatcccagccaggttcagtgcagtggtctgggacagaattcactctcaccatcaccanactagagcctagaagtatttgctagtttatactgtacagcagtacgtaaacaacgtggtactcttcgtttcggacggtacgggaccgagggtacgagtatacgaaaacgtacgtggtaggctagacctacgactctagttcttctacttccttcccgactacgtctacg

SEQ ID NO: 376975 - DNA, 532 bp, Homo sapiens
  misc_feature: GZ8MTXP02JG7VE.51.23.C01.1.454.CMB.2.raw
  modified_base (201)..(201): a, c, t, g, unknown or other
  modified_base (259)..(259): a, c, t, g, unknown or other
  modified_base (294)..(294): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaanagccacctctcctgcagggccagtgagagtattgacatcttcttggcctggtaccaanagaaacctggccaggctccccgactcctcatttangatgcatccaaaagggtcgttggcatcccagcccaggttcagtggcaggtggtcctggggacagaattcactctcaccatcaccagactagacgcctagaagtatttgctagtttatactgtcagcagcgtaaacaacgtggtctcttcgtttcggcggtagggaccgaagggtggagagtacaaacgaactggtggctggccactactctacgtcttcacttctcccgctactctag

SEQ ID NO: 376976 - DNA, 519 bp, Homo sapiens
  misc_feature: GZ8MTXP02FQG53.51.23.C01.1.454.CMB.2.raw
  modified_base (201)..(201): a, c, t, g, unknown or other
  modified_base (259)..(259): a, c, t, g, unknown or other
  modified_base (380)..(380): a, c, t, g, unknown or other
  modified_base (497)..(497): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccaggggaaanagccaccctctcctgcagggccagtgagagtattgacatcttcttggcctggtaccanagaactggccaggctccccgactcctcattatgatgcatccaaagggtcgttggcatcccagcccaggttcagtgcagtggtctgggacagaattcactctcaccatcaccagactagacncctagaaagtattttgactagttttatacgttgtctagacagtacgtaaacaactggacttctcgttcggcggtaggaccaggtgagatacgaaacgactgtgctagcaccatcgtntcttcactcttcccgctatctg

SEQ ID NO: 376977 - DNA, 546 bp, Homo sapiens
  misc_feature: GZ8MTXP02HN92Y.51.23.C01.1.454.CMB.2.raw
  modified_base (202)..(202): a, c, t, g, unknown or other
  modified_base (296)..(296): a, c, t, g, unknown or other
  modified_base (354)..(354): a, c, t, g, unknown or other
  modified_base (379)..(379): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaacctggccaggcctccccgactcctcatttangatgcataccgaaaggtcgtggcatcccagccaggttcagtgcaggtggtcctggganagtaattcactctccacatcaccanacgtagagcctagaagttatttgcttaagtttattactgtcagcagtacgtaacactaggtcttctcgttcggcggtaggaccaagggtggagagtacgaaaacgtacgtggtagcgtgcaacctattccgtgttaaccttcacttccgttcccactacttcctagg

SEQ ID NO: 376978 - DNA, 512 bp, Homo sapiens
  misc_feature: GZ8MTXP02FFQVE.51.23.C01.1.454.CMB.2.raw
  modified_base (201)..(201): a, c, t, g, unknown or other
  modified_base (258)..(258): a, c, t, g, unknown or other
  modified_base (293)..(293): a, c, t, g, unknown or other
  modified_base (382)..(382): a, c, t, g, unknown or other
  modified_base (413)..(413): a, c, t, g, unknown or other
  modified_base (476)..(476): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccaggggaaangccaccctctcctgcagggccagtgagagtatgacatcttcttggcctggtaccaanagaaacctggccaggctccccgactcctcatttangatgcatccaaaagggtcgttggcatcccagccaggttcagtgcagtggtctggggacagaattcactctcaccatcaccagactagancctagaagtattttgctagtttatactgtcngcagacgtaacaacgtgctcttacgttcggcggagggaccaaggtggagatacaaaagactgnggctgcaccatctgtctcactcctcccgcactctag

SEQ ID NO: 376979 - DNA, 606 bp, Homo sapiens
  misc_feature: GZ8MTXP02GNMF6.51.23.C01.1.454.CMB.2.raw
  modified_base (202)..(202): a, c, t, g, unknown or other
  modified_base (296)..(296): a, c, t, g, unknown or other
  modified_base (391)..(391): a, c, t, g, unknown or other
  modified_base (502)..(502): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccacctctcctgcagggccagtgagagtattgacatcttcttggcctggtaccaacagaaacctggccaggcctccccgactcctcatttangatgcataccaaaagggtcttggcatcccagccaggttcagtggcaggtggtcgtggggacagaacttcactctcaccatccacctagactagancctagaagtatttgactaagtttattactgttacagtacgagtacgtaaactaacgtcggtacttcgttccgtttacgggacgggtaacgggaaccgtaagggtacggganaacgtaacgaaaacgaacgttaggtacggtacgtcggacctaccacgttacttcggttccttacgtaactttcccgtttacccgaccttacgttaccttaacgg

SEQ ID NO: 376980 - DNA, 521 bp, Homo sapiens
  misc_feature: GZ8MTXP02I5HFB.51.23.C01.1.454.CMB.2.raw
  modified_base (199)..(199): a, c, t, g, unknown or other
  modified_base (255)..(255): a, c, t, g, unknown or other
  modified_base (285)..(285): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctcaggggaanagccacctctcctgcagggccagtgagagtattgacatcttctggcctggtaccanagaactggcagctcccgactcctcatttangatgcatcaaaagggtcttggcatccagcccaggttcagtgcagtggtcctgggacagtaattcactctcacatcaccagactagagcctagaacgtatttgactagtttatacgtagtcagcagtctaaacatcggacttctcgtttcggacggtagggaccgtaaggtcgagtatacgaaaacgaacgtggtacgctagactacactctgtctcactcctcccgactactctag

SEQ ID NO: 376981 - DNA, 528 bp, Homo sapiens
  misc_feature: GZ8MTXP02J2UZV.51.23.C01.1.454.CMB.2.raw
  modified_base (202)..(202): a, c, t, g, unknown or other
  modified_base (421)..(421): a, c, t, g, unknown or other
  modified_base (499)..(499): a, c, t, g, unknown or other
tcagcgatcgtatacacgaccggtgctcgatttagtacacgtgattagggattgggggaggaactgctcagttaggacccagagggaaccatggaagccccagctcagcttctcttcctcctgctactctggctcccagataccatcggggaactgtgttgacacagtctccagccaccctgtctttgtctccaggggaaangccaccctctcctgcagggccagtgagagtattgacattcttcttggcctggtaccaacagaaacctggccaggctccccgactcctcattatgatgcatccaaaagggtcgttggcatcccagccaggttcagtggcagtgggtcctggggacagaattcactctcaccatcacagactagagcctgaagattttgcagttttattactgtcagcagngtaacaaactggcttctcgtttcggcggtagggaccgaggtcgggagagtacaaaacgactgtaggctgcaccatctnttctctacttccttcccgcctactctacg

SEQ ID NO: 376982 - DNA, 513 bp, Homo sapiens
  misc_feature: GZ8MTXP02FGPZ3.51.23.C01.1.454.CMB.2.raw
  modified_base (201)..(201): a, c, t, g, unknown or other
  modified_base (487)..(487): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccaggggaaangccaccctctcctgcagggccagtgagagtattgacatcttcttggcctggtaccaacagaaacctggccaggctccccgactcctcatttatgatgcatccaaaagggtcgtggcatccagccagtcagtgcagtggcctgggacagaattcactctcaccatcacagactagagcctagaagtattttgcagtttatactgtcagcagacgtaacaactggctctcgtttcggcggtagggaccaagggtggagatacaaaacgaacgtgtaggctgacaccanctgtcttcatccttcccgcactctag

SEQ ID NO: 376983 - DNA, 584 bp, Homo sapiens
  misc_feature: GZ8MTXP02JTD7L.51.23.C01.1.454.CMB.2.raw
  modified_base (202)..(202): a, c, t, g, unknown or other
  modified_base (364)..(364): a, c, t, g, unknown or other
  modified_base (374)..(374): a, c, t, g, unknown or other
  modified_base (381)..(381): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttctggcctggtaccaacagaacctggccagctccccgactcctcatttatgatgcataccgaaaagggtcgttggcactcccagccaggttcagtggcaggtggtctggacagatcactcncacatcacanactagancctgaagtatttgcttagtttattactgtacagacagacgtaacaacgtcggcttcgttcgttcgggacggtaacgggaccgtaagggtcggaagtacgtaacgaaaacggtaacgtggtaggaccgtacggacctaaccgtactttccgttcggttaaccgtttccaacgtttcccgttccccgacctaccgttctttacgg

SEQ ID NO: 376984 - DNA, 600 bp, Homo sapiens
  misc_feature: GZ8MTXP02HWTHG.51.23.C01.1.454.CMB.2.raw
  modified_base (202)..(202): a, c, t, g, unknown or other
  modified_base (375)..(375): a, c, t, g, unknown or other
  modified_base (380)..(380): a, c, t, g, unknown or other
  modified_base (396)..(396): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccgaggggaaanagccacctctcctgcagggccagtgagagtattgacatcttctggcctggtaccaacagaaacctggccaggcctccccgactccctcatttactgatgcatccgaaaaggtcgttggcatccagcaggttcagtgcagtggtcctggacagattcactctcaccatccacanactanacgccttaagaatttntacgtagtttaatttacttcgttagacgacgtacgtaacgtaaacgtaaactacggtcttaccgttcgttttaccgggtaccggaggggttaaccggaaacggtaggggtaaggtaacgttacgaaaacgaaaccgtaggtacggttacgtcgaccgactaacgcttagttccgttctacgttcctcccgctactctacgtacg

SEQ ID NO: 376985 - DNA, 514 bp, Homo sapiens
  misc_feature: GZ8MTXP02GQHQR.51.23.C01.1.454.CMB.2.raw
  modified_base (202)..(202): a, c, t, g, unknown or other
  modified_base (260)..(260): a, c, t, g, unknown or other
  modified_base (475)..(475): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccgaggggaaangccaccctctcctgcagggccagtgagagtattgacatcttcttggcctggtaccaanagaaaacctggccaggctccccgactcctcatttatgatgcatccaaaagggtcgttggcatccagccaggttcagtgcagtggtcctggacagaattcactctcacatcaccagactagagctgaagtatttgctagtttatactgtcagcagacgtaaacaactggctctcgtttcggcggaggaccgaggtggagatacgaaaacgaactgngactgacaccatctcgtcttcactccgttccacatctag

SEQ ID NO: 376986 - DNA, 593 bp, Homo sapiens
  misc_feature: GZ8MTXP02G1MTZ.51.23.C01.1.454.CMB.2.raw
  modified_base (202)..(202): a, c, t, g, unknown or other
  modified_base (300)..(300): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccgaggggaaangcccaccctctcctgcagggccagtgagagtattgactatcttcttggcctggtaaccaacagaaacctggccaggcctccccgactcctcatttacngatgcataccgaaaagggtcgttggcactccagccctaggttcaggtggacaggtgggtccgtagggacaggtaatcactctccacctatccaccagaactagacgtactgtaaacgttattacgtacttaagtttattaccgtgtacagtacagtaacgtaactaaacgtcggtactcttcggtttacgggacgggtacgggaaccggtaaggtaggagtacgtaacgaaaacgtaactggtagactcgactaccagttctgtcctctacttccctccgacctacgtctacg

SEQ ID NO: 376987 - DNA, 560 bp, Homo sapiens
  misc_feature: GZ8MTXP02FZWDT.51.23.C01.1.454.CMB.2.raw
  modified_base (202)..(202): a, c, t, g, unknown or other
  modified_base (262)..(262): a, c, t, g, unknown or other
  modified_base (394)..(394): a, c, t, g, unknown or other
  modified_base (488)..(488): a, c, t, g, unknown or other
  modified_base (506)..(506): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagcccaccctctcctgcagggccagtgagagtattgacatcttcttggcctggtaccaanagaaacctggccaggctccccgactcctcactttatgatgcatccaaaagggtcgttggcatcccagcccaggttcagtggcaggtgggtcctgggacagaattcgactctcaccatcaaccagactagacncctagaaagtatttgactagtttattctgttacagacagacgtaaacaaacgtggctcttcgtttcgggacggagggaccgaagggtggaaganacgaaaaccgaaacgtgnggactggaccaccactctacgtcgtttacacttccttcccgacctactcctaag

SEQ ID NO: 376988 - DNA, 624 bp, Homo sapiens
  misc_feature: GZ8MTXP02HH8F7.51.23.C01.1.454.CMB.2.raw
  modified_base (200)..(200): a, c, t, g, unknown or other
tcagcgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccacctgtctttgtctcgagggaanagccacctctctgcagggccagtgagagtattgactattcttcttggcctggtaaccaacagaaacctggccaggcctccccgactccctacatttacgtgatgacataccgtaaaagggtcgttaggctactcccagccgtaggttcaggtcggctagggtggtccgtgggactagtacttcactctccacactccaccagtactacgaacgtccctagaacgttatttcgacgtacgttttaacttaccgtcgttacgaacgtcgtaacggtaacgttaaaccgtaacgttcgggtacctcgtttccgggtttaccgggacgggtaacgggaccgtaagggtacggatacgtacgaaaacggtcgtacggtcggactgacctacgtactctcgtcttcacttcccttaccgcctacgtcctg

SEQ ID NO: 376989 - DNA, 599 bp, Homo sapiens
  misc_feature: GZ8MTXP02IDANT.51.23.C01.1.454.CMB.2.raw
  modified_base (202)..(202): a, c, t, g, unknown or other
  modified_base (259)..(259): a, c, t, g, unknown or other
  modified_base (291)..(291): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccacctctcctgcagggccagtgagagtattgacatcttctggcctggtaaccaanagaaactggcaggctcccgactcctcatttangatgcatccaaaagggtcgttggcatcccagcaggttcagtgcagtggtctggacagatcactctcacatccgaccagactagcgcctgaagtatttgactagtttattactgtcagtcagacgtaaacaacgtggcttcttcgtttccgggcggtacgggaccgaagggttggaagacgttaacgaaaacgtaaaccgttggtaggggtacttcggacctacccggtaaacttccttcggttaacccgttttacctaaccgttttcccgtttccccccgtacccttaaacgtttcccctttaacggg

SEQ ID NO: 376990 - DNA, 625 bp, Homo sapiens
  misc_feature: GZ8MTXP02H6K7U.51.23.C01.1.454.CMB.2.raw
  modified_base (204)..(204): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaaggggaaangcccaccctctcctgcgagggccagtgagagtatgactatcttcgtggcctggtaaccaacagaaacctggccaggcctccccgactcctctaatttactgatcgcaactaccgtaaaagggtcgttaggacacgtacccacgtccgaggttcaggtggcgtaggtggtccgaggggacaggtaattcactcctcacctataccaccagactaagctacccgtagaagttatttcgatagttttattactgtactacgcaagtacgtaaacacgtgtcttcgtcgttacggggacggaacgggaccgtaagggtacggaacgtaagtaacgaaaaccggtatagggtacggtcacggacctacgacgttcgttacgtaaccttaccgtacttcccgtttacccggacctactttactacgg

SEQ ID NO: 376991 - DNA, 554 bp, Homo sapiens
  misc_feature: GZ8MTXP02JSCZT.51.23.C01.1.454.CMB.2.raw
  modified_base (203)..(203): a, c, t, g, unknown or other
  modified_base (295)..(295): a, c, t, g, unknown or other
  modified_base (385)..(385): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaaggggaaangccaccctctcctgcagggccagtgagagtattgacattcttctggcctggtaccaacagaaacctggccaggctccccgatcctcatttangatgcatccaaaagggtcgtggcatcccagcccaggttcagtggcaggtgggtctgggacagattcactctcaccatcaccagactagancctgaaagtattttgctaagttttattacctgttacagcagtacgtaaacaaacgttggccttcttacgtttcgggcggacgggacaaggggtgagtatacgaaacgtaacgtgtacgggctcgactaccacgttctgttaacttcaacttccttaccgcctactctag

SEQ ID NO: 376992 - DNA, 560 bp, Homo sapiens
  misc_feature: GZ8MTXP02H0OB5.51.23.C01.1.454.CMB.2.raw
  modified_base (203)..(203): a, c, t, g, unknown or other
  modified_base (245)..(245): a, c, t, g, unknown or other
  modified_base (260)..(260): a, c, t, g, unknown or other
  modified_base (297)..(297): a, c, t, g, unknown or other
  modified_base (529)..(529): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagcccaccctgtctttgtctccaggggaaanagccaccctctcctgcagggccagtgagatattgacatcttntggcctggtaccaanagaactggcaggcctccccgactcctcattatgatgnactaccgaaaagggtcgtggcacgtcccagccctaggttcaggtcggcaggtgggtcctggggacagaattcactctcaccatccactagactagagtcctagaagtatttgctaagtttattactgtcaagcagtacgtaaacaactggacttcgttcgtttcggacgggaagggaccgaagggtggaacgagtaacgaaaacgtacgtaggtgacgtcgaccacactctntcctttcacttccttccgaccctatttccag

SEQ ID NO: 376993 - DNA, 602 bp, Homo sapiens
  misc_feature: GZ8MTXP02GIJ4T.51.23.C01.1.454.CMB.2.raw
  modified_base (202)..(202): a, c, t, g, unknown or other
  modified_base (369)..(369): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangtcaccctctcctgcagggccagtgagagtattgacattcttcttggcctggtaaccaacagaaacctggccaggctccccgactcctcatttatgatgcataccgaaaagggtcgttggcatcccagccaggttcagtgcagtggtcctgggacagatcactctcnccatcaccagactagacgcctagaaagtatttagcttagttttattactgtactagacagaccgtaaacaaacgtgggtaccttcgttcgtttacgggcgggaaggggaccgaaaggggttacgggaagaacgttaacgaaaacggtaacgtggttagggacttggacctaaccgtaacttaccttgttccttactaactttcccgttaccccgacctactttccgttaacgg

SEQ ID NO: 376994 - DNA, 614 bp, Homo sapiens
  misc_feature: GZ8MTXP02IIKJR.51.23.C01.1.454.CMB.2.raw
  modified_base (202)..(202): a, c, t, g, unknown or other
  modified_base (258)..(258): a, c, t, g, unknown or other
  modified_base (293)..(293): a, c, t, g, unknown or other
  modified_base (389)..(389): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccacctctcctgcagggccagtgagagtattgacatcttctggcctggtaccaanagaaacctggccaggctccccgactcctcatttangatgcatccgaaaagggtcgttggcatcccagccgaggttcagtggctaggtggtccgtgggacagaattcactctcaccatcaccagactagacncctagagtatttgactaagtttattactagtactagcagacgtaaacaacgtcgggtacttcgttcggttacgggcggggtaacgggtaccgtaaggggtagggtaagtaacgtaaccgaaaacggtaaacgtcgggttacggacgttacggaccgtaccaacgttccgttaacggttccgtttactaactttcccgttacccgtaccttacgttcctttaacgg

SEQ ID NO: 376995 - DNA, 566 bp, Homo sapiens
  misc_feature: GZ8MTXP02FV4BM.51.23.C01.1.454.CMB.2.raw
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaaggggaaagcgcccaccctctcctgcgagggccaggtgagagtattgactattcttcgttggcctaggtaaccaaacaagaaaaccctggccaggcctccccgactccctcatttatgatgcatccgaaaagggtcgttggcatcccagccaggttcagtgcagtggtcgtgggacagaattcactctcacatcacagactagacgctagaaagtatttgcttaagttttatacgtgttacagacacgtacgtaaacaaacgtggtcctcgtttcgtttcggacggaacgggaccgaaagggtcggagaatacgaaaacgacgtgtacggctcgacaccatctgtcttacactccgtcccactacgtctag

SEQ ID NO: 376996 - DNA, 627 bp, Homo sapiens
  misc_feature: GZ8MTXP02HGZDV.51.23.C01.1.454.CMB.2.raw
  modified_base (202)..(202): a, c, t, g, unknown or other
  modified_base (311)..(311): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanacgcccaccctctcctgcgagggccagtgagagtattgacatcttcgttggccttggtaaccaacgaagaaacccgtggaccaggccctccccgactccctctatttangatgcactaccgaaaagggtcgtggcactcccagcccgtaggttcaggtcggactaggttgggtccgtaggggactagtaactttcaacttctccaacctataccacaagtactaggcgacctagaaagttatttacgacttaagttttattaccgtgttcagacgtacgtacgtaaactacgtcggtctcgttcgtttacgggcgggtaaggaccgaagggtggagacgtaacgaaaacgtaacgtggacggctgaccctaactcttcgttcgttccttcgtaacttccccgtttacccgctaacttccgtacgg

SEQ ID NO: 376997 - DNA, 565 bp, Homo sapiens
  misc_feature: GZ8MTXP02HWATT.51.23.C01.1.454.CMB.2.raw
  modified_base (201)..(201): a, c, t, g, unknown or other
  modified_base (375)..(375): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaangccacctctcctgcagggccagtgagagtattgactatcttctggcctggtaccaacagaaacctggccaggctccccgactcctcatttatgatgcataccaaaagggtcgttggcatcccagccaggttcagtgcagtggtcctgggacagattcactctcaccatcaccanactagacgcctagaaagtatttgactagttttatactgtctagcagacgtaaacaacttggtacttcgttcgtttcgggacgggtaacgggaccgtaaagggtggaacgagttacgaaaacgtaacgtaggtcggactcggactaccgactcgtacgtccttcacttccttacccgcctacttccgtacg

SEQ ID NO: 376998 - DNA, 608 bp, Homo sapiens
  misc_feature: GZ8MTXP02G9J4X.51.23.C01.1.454.CMB.2.raw
  modified_base (201)..(201): a, c, t, g, unknown or other
  modified_base (294)..(294): a, c, t, g, unknown or other
  modified_base (395)..(395): a, c, t, g, unknown or other
  modified_base (405)..(405): a, c, t, g, unknown or other
  modified_base (430)..(430): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaangccacctctcctgcagggccagtgagagtattgacattcttctggcctggtaccaacagaaacctggccaggcctccccgactcctcatttangatgcataccgaaaagggtcgttggacatcccagcctaggttcaggtcgcaggtcggtccgtggggacagaattcactctcacactcaaccagactagacnctagaaagtntttagcttaagtttattactgttanagtcaagtacgtaaacaaacgttcggtacttcgttcgtttacgggacgggtacgggaaccgtaaggggtcggtaaggaactaacgaaaacggtaacgtcggttaggccgtacggacctaaccgtacttcgtacgttcctttacgtaccttccgttacccgtacctaacgttctaacgg

SEQ ID NO: 376999 - DNA, 639 bp, Homo sapiens
  misc_feature: GZ8MTXP02HOR38.51.23.C01.1.454.CMB.2.raw
  modified_base (305)..(305): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagagccaccctctcctgcagggccagtgagagtattgactatcttcgttggcctggtaccaacagaaacctggccacggcctccccgactccctactatttacngatgactactaccgtaaagggtcgtaggcactccccgagtccgtaggttcagtggcgtaggtggtccgtagggacagtacttcactctcaccatcaccagactacgacgtcctagaagttatttgacttagttttacttactgtacgagtacgtacgtacgtaaacgtacgtacggttctacgttacggttacgggacgggtaacgggtaccgtaaggggtggaacgtacgtaaacgaaaacggtacggtaggtcggacgttacgaccgtaccgtacgttccgttcgtaaccgttcctacgtttcccgtaccccgtccttacgtccgttaacgg

SEQ ID NO: 377000 - DNA, 559 bp, Homo sapiens
  misc_feature: GZ8MTXP02HLHRP.51.23.C01.1.454.CMB.2.raw
  modified_base (202)..(202): a, c, t, g, unknown or other
  modified_base (385)..(385): a, c, t, g, unknown or other
  modified_base (391)..(391): a, c, t, g, unknown or other
  modified_base (423)..(423): a, c, t, g, unknown or other
  modified_base (527)..(527): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccacctctcctgcagggccagtgagagtattgacatcttctggcctggtaaccaacagaaacctggccaggcctccccgactcctcatttatgatgcataccgaaaagggtcgttggcatcccagccaggttcagtggcaggtggtccctggggacaggaattcactctcaccatcaccanactagnacctgaaagtatttgctaagttttattacgtntcagtcaagtacgtaaacactaggtctcgttccgttcgggacggacgggaaccgaggtaggagaatacgaaaacgtacgtggtagctaggacaccgacttcgtntccttacacttccctcccgcctacttccgtag

SEQ ID NO: 377001 - DNA, 532 bp, Homo sapiens
  misc_feature: GZ8MTXP02FP0TG.51.23.C01.1.454.CMB.2.raw
  modified_base (201)..(201): a, c, t, g, unknown or other
  modified_base (259)..(259): a, c, t, g, unknown or other
  modified_base (294)..(294): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccaggggaaangccaccctctcctgcagggccagtgagagtattgacatcttcttggcctggtaccaanagaaacctggccaggctccccgactcctcatttangatgcatccaaaagggtcttggcatccagccaggttcagtgcaggtggtcctgggacagaattcactctcaccatccaccagaactagacgcctagaagtatttgcttaagtttatactgtacagacagtacgtaaacaactggctcttcgttcggcggaggaccgaggtggagatacgaaaacgtacgtgtggctcgacaccagtctacgtcttcacttccttcccgctactctacg

SEQ ID NO: 377002 - DNA, 663 bp, Homo sapiens
  misc_feature: GZ8MTXP02FTN6Y.51.23.C01.1.454.CMB.2.raw
  modified_base (297)..(297): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccaggggaaagagccaccctctcctgcagggccagtgagagtattgacattcttcttggcctggtaccaacagaaacctggccaggcctccccgactcctcatttangatgcataccgaaaagggtcgttggcactccagccaggttcagtgcaggtggtcgtgggacagaattcactctcacatcaccagactagacgctagaagtattttgacttagtttaatacttagtcgtagacgagtacggtaaaaccacgttacggtccttaccgttcggtttaccgggacggggtaacggggaacccgtaaggggtaggtaacggaacgttaaacgaaaaaccggtaaaccgttggggttacggaccgtttaacggacctaaacccttaacggttacctttcggtttaaccctttaacccgttaaccgtttaccccgtttacccccgtacccgttaaaactttcccgtttaacgg

SEQ ID NO: 377003 - DNA, 514 bp, Homo sapiens
  misc_feature: GZ8MTXP02FFCPK.51.23.C01.1.454.CMB.2.raw
  modified_base (203)..(203): a, c, t, g, unknown or other
  modified_base (261)..(261): a, c, t, g, unknown or other
tcagcgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaanagaaaacctggccaggctccccgactcctcatttatgatgcatccaaaagggtcgttggcatcccagccaggttcagtggcagtgggtcctggggacagaattcactctcaccatcaccagactagagcctgaagattttgcagtttatactgtcagcagcgtaacaactggctctctttcggcggagggaccaaggtggagatacaaaacgaactgtaggctgcaccatctgtcttcactctcccgcatctg

SEQ ID NO: 377004 - DNA, 622 bp, Homo sapiens
  misc_feature: GZ8MTXP02ICBU3.51.23.C01.1.454.CMB.2.raw
  modified_base (202)..(202): a, c, t, g, unknown or other
  modified_base (394)..(394): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaacctggccaggctccccgactcctcatttatgatgcatccgaaaagggtcgttggcatcccagccaggttcagtggcagtgggtctgggacagattcactctcaccatcacagactagagcctagaagtntttgctagtttatttactggttacagtcagtacgtaacaaacgtcggacttccgttcgtttcgggccggaaggggtacccgaagggtcgggtaagaacgttaacgaaaaccggtaaacgtagggttacggaccgttagggacctaaccccgtagtttaccttacggtttcccgttacgtaacgtttccccttttacccccggaccccgttaatttccccgtttaacgg

SEQ ID NO: 377005 - DNA, 513 bp, Homo sapiens
  misc_feature: GZ8MTXP02IT2LG.51.23.C01.1.454.CMB.2.raw
  modified_base (201)..(201): a, c, t, g, unknown or other
  modified_base (258)..(258): a, c, t, g, unknown or other
  modified_base (396)..(396): a, c, t, g, unknown or other
  modified_base (418)..(418): a, c, t, g, unknown or other
  modified_base (420)..(420): a, c, t, g, unknown or other
  modified_base (501)..(501): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccaggggaaanagccacctctcctgcagggccagtgagagtattgacatcttctggcctggtaccaanagaaacctggccaggctccccgactcctcatttatgatgcatccaaaagggtcgttggcatcccagcccaggttcagtgctagtggtcctgggacagaattcactctcaccactccaccagactagacgctagaagtntttagctagtttatactgtcancngactaacactgctctcgttgcggtaggacagggtgagatacaaaacgactgtaggctgcacactctcgtctctactctccncgtactcgtacg

SEQ ID NO: 377006 - DNA, 555 bp, Homo sapiens
  misc_feature: GZ8MTXP02GNMU0.51.23.C01.1.454.CMB.2.raw
  modified_base (202)..(202): a, c, t, g, unknown or other
  modified_base (261)..(261): a, c, t, g, unknown or other
  modified_base (296)..(296): a, c, t, g, unknown or other
  modified_base (378)..(378): a, c, t, g, unknown or other
  modified_base (428)..(428): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaanagaaacctggccaggctccccgactcctcatttangatgcataccgaaaaggtcttggcatcccagccaggttcagtgcaggtggtcctgggacagaattcactctcacatcaccanactagagcctagaaagtatttgactagtttatactgtcagcagactaaanaactggtctcttcgtttcggcggtacgggacctaaagggtcggagactacgaaaaccgtaacgtggtggccttaggacctacccattccgtgtaaccctttcgtacttccttcccgactactcgtcg

SEQ ID NO: 377007 - DNA, 622 bp, Homo sapiens
  misc_feature: GZ8MTXP02IIAT5.51.23.C01.1.454.CMB.2.raw
  modified_base (201)..(201): a, c, t, g, unknown or other
  modified_base (256)..(256): a, c, t, g, unknown or other
  modified_base (284)..(284): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccaggggaaangccacctctcctgcagggccagtgagagtattgacatcttcttggctggtaccanagaactgcagctcccgctcctcatttangatgcatccgtaaaagggtcgttggacatcccgagcctaggttcagtgcgtaggtcgggtccgtggggacagaattcactctcacatcaccagactagagcctagaacgtatttgctagtttattactgttacagacagtacgtaaacaacttcggtcttcgttacgtttaccgggacgggtaacgggaaccgtaagggttagggaacgtaagtaacgaaaaccggtacttaacggtcgggtaccgttacggacctaacccgtactttacgttacggttccgtttaccgtaaacgtttcccctttaaccccggcccgtttaaccttccgtttaacggg

SEQ ID NO: 377008 - DNA, 615 bp, Homo sapiens
  misc_feature: GZ8MTXP02GGNFL.51.23.C01.1.454.CMB.2.raw
  modified_base (204)..(204): a, c, t, g, unknown or other
  modified_base (266)..(266): a, c, t, g, unknown or other
  modified_base (301)..(301): a, c, t, g, unknown or other
  modified_base (407)..(407): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagcccaccctgtctttgtctccgaggggaaanagcccaccctctcctgcagggccagtgagagtattgactatcttcttggcctggtaaccaanagaaacctggccaggctccccgactcctcatttangatgcataccgaaaagggtcttggcatcccagccaggttcagtggcaggtggtcctggggacagaattcacttctcaccatccaccagactagacgcctgaaagtnttttgacttaagtttattactgttaccgagcaacgtacgtaaacaaacgtcggtaccttcttaccggtttcgggaccgggtaggggaacccgtaaagggtcgggaagtaacgtacgaaaaccggtaacgtaggtgggtaccgtaggccaaccctattcgttcgttaaccgttcctaacttcccgtacccccgctaaccttcgtaacgg

SEQ ID NO: 377009 - DNA, 697 bp, Homo sapiens
  misc_feature: GZ8MTXP02F0Z6T.51.23.C01.1.454.CMB.2.raw
  modified_base (202)..(202): a, c, t, g, unknown or other
  modified_base (329)..(329): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangcccaccctctcgtcgcgacggccgagtagagtagttatacgactattcttcgttcgcgttacggtaaccaacgaacgtaaacccgtcggaccgacggtcccctaccccgtactcctacttatttancgtatcgactaacgtaaccggtaaagggttcgtagacctacctccgacgtccgtacggttcgaggtggacgtagggtcgggtcgtagggactaagtactcgacctctccgacactaccgaaccagtactacgacgtacgtaaggtactttagttacgactttaagttttaccagttagtactacgagacgtaaaccgtaaactcggtcgttaccttaccggttcgggttacggggaccgggtaaacgggtaacccggtaggggtaaggtactaaaccgtaaaacgtaaacccggtaagttgggtacgacgtacgaccctaacgtctacgtttccgtctaccgtctttaccccgactactcttcgtacg

SEQ ID NO: 377010 - DNA, 587 bp, Homo sapiens
  misc_feature: GZ8MTXP02J17I1.51.23.C01.1.454.CMB.2.raw
  modified_base (202)..(202): a, c, t, g, unknown or other
  modified_base (245)..(245): a, c, t, g, unknown or other
  modified_base (391)..(391): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttnttggcctggtaccaacagaaacctggccaggcctccccgactcctcatttatgatgcataccgaaaagggtcgttggcactcccagcctaggttcaggtgcaggtggtccgtgggacagtaatcactctcacatcacagactaganccgtagaatactttgacttagtttacttacgtgttacagacagtaccgtaacaacgtcggcttacgtcggtttcggacggtaacgggaccgaagggttggaagtacgtaacgaaaacgtaacgtggtacggactacggcctaaccacgttccgtacgttcttacctacttcccttccccggcctaactccgttacg

SEQ ID NO: 377011 - DNA, 498 bp, Homo sapiens
  misc_feature: GZ8MTXP02G4YRH.51.23.C01.1.454.CMB.2.raw
  modified_base (202)..(202): a, c, t, g, unknown or other
  modified_base (296)..(297): a, c, t, g, unknown or other
  modified_base (300)..(301): a, c, t, g, unknown or other
  modified_base (321)..(321): a, c, t, g, unknown or other
  modified_base (326)..(326): a, c, t, g, unknown or other
  modified_base (331)..(331): a, c, t, g, unknown or other
  modified_base (342)..(342): a, c, t, g, unknown or other
  modified_base (344)..(344): a, c, t, g, unknown or other
  modified_base (351)..(351): a, c, t, g, unknown or other
  modified_base (356)..(356): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (367)..(367): a, c, t, g, unknown or other
  modified_base (370)..(370): a, c, t, g, unknown or other
  modified_base (377)..(377): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaaacctggccaggctccccgactcctcatttannatnnatacaaaggtcgtgcatcancagtnagtgnagtggctggananatcatcncacancacananananctnagtattntntattattatntnagacagacgtaacaactgtctcttcgttcgtcggacggacgaaggaggagagtacaaacgaacgtagtgctcgacactactctctctctactctcctcctactctcg

SEQ ID NO: 377012 - DNA, 538 bp, Homo sapiens
  misc_feature: GZ8MTXP02FF68Y.51.23.C01.1.454.CMB.2.raw
  modified_base (202)..(202): a, c, t, g, unknown or other
  modified_base (239)..(239): a, c, t, g, unknown or other
  modified_base (260)..(260): a, c, t, g, unknown or other
  modified_base (368)..(368): a, c, t, g, unknown or other
  modified_base (373)..(373): a, c, t, g, unknown or other
  modified_base (386)..(386): a, c, t, g, unknown or other
  modified_base (496)..(496): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgctccgaggggaaangcccaccctctcctgcagggccagtgagagtatgacnttctcgttggcctggaccaanagaaacctggccaggcctccccgactccctcatttatgatgcatccgaaaagggtcgttggcatcccagcccaggttcagtgcagtgggcctggggacagatcactcncaccntcaccagactagncctagaaagtatttgctagtttatactgtcagcagtacgtaaacactggctcgttcgttcgggcgtacggggacaaacggggtgagatacgaaaacgtaactggtcggcncgccactactctcgtcgtctactccttcccgctactctacgg

SEQ ID NO: 377013 - DNA, 624 bp, Homo sapiens
  misc_feature: GZ8MTXP02GCZL3.51.23.C01.1.454.CMB.2.raw
  modified_base (248)..(248): a, c, t, g, unknown or other
  modified_base (264)..(264): a, c, t, g, unknown or other
  modified_base (300)..(300): a, c, t, g, unknown or other
tcagcgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgactattcttnttggcctggtaccaanagaaacctggccaggcctccccgactcctcatttangatgcataccgaaaagggtcgttggcactcccagacccaggttcaggtggctaggtgggtccgtgggacagtaacttcactctcaccatcaccagaactagagtcctagaaagtattttgacttagtttatacgttgtacaagtccagtaccgtaaacgtactcggtactcgttacggtttacgggaccgggtagggaaccgtaaggggtacggagtaacgtaacgaaaacggtaacgtcggtaggtaccgtcgtacctacctaacgtccgttcgttaaccttactaaccgttcccgttaccccgtccttaactcccgttaacg

SEQ ID NO: 377014 - DNA, 737 bp, Homo sapiens
  misc_feature: GZ8MTXP02FWVEX.51.23.C01.1.454.CMB.2.raw
  modified_base (267)..(267): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaagagcccaccctctcctgcagggccagtgagtagtattgactattcttcttggcctaggtaccaanagaaacctggccaggcctccccgactcctctactttatgatgcataccgaaaagggtcgttggcactcccagcctaggttcgagtgcgaggtgggtccgtggggacagtaattcactctcacatcaccagactagacgtcctagaaacgttagttttacggatttaaggtttttaacttaccgttagtttacccgtaaggaccgtaacggttaaccgggttaaaacctaaaccggttacgggggtacctttcccgtttaccgggttttaccgggggacccggggtaacgggggtaaaccccggtaaagggggttaccggggaagtaacgtttaaaccggaaaaccggtaacggtttaacggggtcgggtaccgttacgggtaacccaacccggttaaacttccggtttaacgttcccgtttacggtaaacctttcccgttcccccggtactaacggttccctttaacggg

SEQ ID NO: 377015 - DNA, 605 bp, Homo sapiens
  misc_feature: GZ8MTXP02IO0W5.51.23.C01.1.454.CMB.2.raw
  modified_base (201)..(201): a, c, t, g, unknown or other
  modified_base (261)..(261): a, c, t, g, unknown or other
  modified_base (296)..(296): a, c, t, g, unknown or other
  modified_base (366)..(366): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaanagccacctctcctgcagggccaggtgagagtattgactatcttcttggcctggtaccaanagaaacctggccagcctccccgactcctcatttancgatgcataccgtaaaagggtcgttaggcaactcccgagccctaggttcagtgcaggtggtcctgggganagtaattcactctcactatccaacacgactagacgtctagagtatttgacttagtttacttactcgttacacgtcgaagtactaaacgtaacgttcggtacttccgttcgtttacccggggacggaacgggtaaccggtagggtaacggaacgtagtaaccgaaaacgttacgtaggttcggactacggacctacacttcgttactcttctacgttccctccgaccttagtacgttacg

SEQ ID NO: 377016 - DNA, 560 bp, Homo sapiens
  misc_feature: GZ8MTXP02JR7WD.51.23.C01.1.454.CMB.2.raw
  modified_base (203)..(203): a, c, t, g, unknown or other
  modified_base (308)..(308): a, c, t, g, unknown or other
  modified_base (383)..(383): a, c, t, g, unknown or other
  modified_base (432)..(432): a, c, t, g, unknown or other
tcagcgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaangcccaccctctcctgccagggccagtgagagttattgactattcttcgttggcccttggtaacccaacagaaaaccctggccaggctccccgactcctcatttangatgcataccgaaaagggtcgttggcatcccagcctaggttcagtggcaggtggtcctggggacagattcactcncacatcacagacagacgcctagacgtatttgctagtttattactgtcancgagacgtaacaacgtggactcgtcgttcggcggaggaccgaggtggacgatacgaaacgtaaacgtcgtaggactcggactacacttcgtcgtcttctaactccgttacccgactactccgtttacg

SEQ ID NO: 377017 - DNA, 558 bp, Homo sapiens
  misc_feature: GZ8MTXP02IWSCD.51.23.C01.1.454.CMB.2.raw
  modified_base (232)..(232): a, c, t, g, unknown or other
  modified_base (345)..(345): a, c, t, g, unknown or other
  modified_base (383)..(383): a, c, t, g, unknown or other
  modified_base (546)..(546): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtcttttgtctccaggggaaagagccaccctctcctgcagggccagtgagngtattgacatcttcttggcctggtaccaacagaaacctgccaggctccccgactcctcattatgatgcatccaaaaggtcgttggcatccagccaggttcagtgcagtggtcngggacagattcactctcaccatccgaccagactagacnccgtgaacgtatttgacttaagtttattacctagttcagctagacgtaaactaactggtctcttcgtttcgggacggagggaccgagggtacggagtaagtacgaaaacgtaacgtggtaggctcggacctacaactcgtgttccgttacactttccctcccncctactcttacg

SEQ ID NO: 377018 - DNA, 616 bp, Homo sapiens
  misc_feature: GZ8MTXP02I5NOG.51.23.C01.1.454.CMB.2.raw
  modified_base (203)..(203): a, c, t, g, unknown or other
  modified_base (460)..(460): a, c, t, g, unknown or other
  modified_base (578)..(578): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccgaggggaaangccaccctctcctgcagggccagtgagagtattgactatcttcgtggccctggtaaccaacagaaacctggccaggcctccccgactcctctatttatgatcgctaactaccgtaaaagggttcggttggacctacttcccaggtcccgtaggttccaaggttcgggctagggttcggggtcccgtaggggacctagtaacttccacctctccacctactacgacccagtaacgtaggacgtaccgtagtaaacgtnttttagaccttaagttttattacgtgttacaggacaggtacgtaaacacgtggtacttcgtcgttcggacggtacgggacgtaaggtggagactagaaccggtaatggtacgcgtacnctactactcgtctcgtctcgtccgtaccactctcgtcg

SEQ ID NO: 377019 - DNA, 721 bp, Homo sapiens
  misc_feature: GZ8MTXP02FMYME.51.23.C01.1.454.CMB.2.raw
  modified_base (205)..(205): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgttctttgtctccgaaggggaaanagcccaccctctcctgcagggccagtgagtagtattgactattcttcgttggccttaggtaacccaaacaacggaaaacccgtggacccgacggaccctacccccgactccctactactttagtgtatgcaataccgtaaaagggttcgtggcactcccgagcccgaggtcagtggactagggtgggtccgtagggaactagtaacttcacctctcaaccatcaaccagaacgtacgacgtacctagtaaacgtttagtttcgaacgtttaaagtttttaacttacgtttacgtaccgaagttaccggaacgttaaacccgggttaaaacctaacgtttcggggtaaccctttccggtttaccggggtttaccggggaacccgggggtaacgggtaacccgtaagggggtacggtaacgaacgtaacgtaaaaacggtaccgtgggtaccggtacgtaccgactacccgtatcgtacttccgttctacgtttcccgtacccgctactcggttaacg

SEQ ID NO: 377020 - DNA, 579 bp, Homo sapiens
  misc_feature: GZ8MTXP02HK06G.51.23.C01.1.454.CMB.2.raw
  modified_base (200)..(200): a, c, t, g, unknown or other
  modified_base (259)..(259): a, c, t, g, unknown or other
  modified_base (296)..(296): a, c, t, g, unknown or other
  modified_base (329)..(329): a, c, t, g, unknown or other
  modified_base (418)..(418): a, c, t, g, unknown or other
  modified_base (443)..(443): a, c, t, g, unknown or other
  modified_base (507)..(507): a, c, t, g, unknown or other
  modified_base (568)..(568): a, c, t, g, unknown or other
  modified_base (572)..(572): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctccagataccagtcggggaaactgtgttgacacagtctccagccacctgtctttgtctcgaggggaancgccacctctcctgcagggccagtgagagtattgactatcttctggcctaggtaccaanagaacctggccaggcctccccgactcctacatttacngtatgcacgttaccgaaaagggttcgttacggntaacgtcccgagtcccgtaggttcaggtcggcgtaggtggtccgtaggggacagtacttcgacttctccactactccacagtacagacncttagacgttattcgacttagtttntactgtcagcagtactaacgactacggtctcgtcggttacggcggaacggacgagggtacgganagtaacaaaacgtgtggtactcgagacctacgacttcgtatccttctacctttccgtaccncctntaccgta

SEQ ID NO: 377021 - DNA, 664 bp, Homo sapiens
  misc_feature: GZ8MTXP02JOYKW.51.23.C01.1.454.CMB.2.raw
  modified_base (202)..(202): a, c, t, g, unknown or other
  modified_base (256)..(256): a, c, t, g, unknown or other
  modified_base (286)..(286): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttctgctggtacanagaactgccaggctcccgatcctcacttangatgcatccaaaaggtcgtggcatccagccagtcagtgcaggtggtccgtgggacagaattcactctcaccatcaccagactagacgcctagaagtattttggacttaggttttaattaccttagggttacccaaaggtccgaacggtaccggttaaactaaaaccgttcggggtaacccttcgtttcccggttttaccgggggtaccgggaaacgggggtaaccccgttaaagggggtaggttaacggaacgttacgaaaaaccggtaaaccgtaagggtacggtcttacggggaaccaccccgtaagttcccttccggttaacgttcccgtaaactttcccttcccccggtacccgttaacgttcccttttaccgg

SEQ ID NO: 377022 - DNA, 675 bp, Homo sapiens
  misc_feature: GZ8MTXP02JSJJ6.51.23.C01.1.454.CMB.2.raw
  modified_base (202)..(202): a, c, t, g, unknown or other
  modified_base (232)..(232): a, c, t, g, unknown or other
  modified_base (301)..(301): a, c, t, g, unknown or other
  modified_base (392)..(392): a, c, t, g, unknown or other
tcagcgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccacctgtctttgtctccgaggggaaancgccaccctctcctgcacgggccagtgagngtattgacattcttctgcctaggtaaccaacagaaacctggccgagcctaccccgactcctactatttngactgcactacgtaaaggtcgtgcatccagtccgtgtacgagtgacgtaggtcggtacgtgggaactagaacttcactacctcgaactacnccaaccgagactagacgtctagtaattatttgactttaagtttacgttaactgttacgagtacgaacgttaaccgtaaacgtaacggttcgtaacccgttccggttaccgggtttaccggggaccgggttaaacggaacccgggtaaaggggttcggaacggttaaaccgtaaacccggaaaaaggtaccggttgggaccgggttacctggtaaaccccaacccggtttacgttccgttacgttccgttaccgtaccttaccccttaccgtactacttcgtag

SEQ ID NO: 377023 - DNA, 645 bp, Homo sapiens
  misc_feature: GZ8MTXP02HGORW.51.23.C01.1.454.CMB.2.raw
  modified_base (204)..(204): a, c, t, g, unknown or other
  modified_base (323)..(323): a, c, t, g, unknown or other
tcagcgatcgtatacacgaccggtgctcgatttagtacacgtgattagggattgggggaggaactgctcagttaggacccagagggaaccatggaagccccagctcagcttctcttcctcctgctactctggctccagataccatcggggaaactgtgttgacacagtctccagccacctgttctttgtctccgaaggggaaanacgcccacctctcctgcgacgggccagtgagtagtatgactattcttcgttcggccttacggtaaccaaacgaacgaaaccgtcggaccgacggccctaccccgactcctactatttangtatcgacaactaccggtaaaagggttcgttcggcacgtacccgagcccgtaggtcgaggtggcgtagggttgggtccgtggggaacaggtaattccgactctccaccactaccaacgagtaacagacgtacctagtaaagttagtttacgacttaagttttattaccgtgtacagacaggtactaaatacgtgtaccttcgttcggttacgggacgggacggaacggtaaggtacggaagtagaaacgaaacgaacgttcggtagtactacgacgtactcgtacgttcgttctactacgttcctaccgtactacgtctacg

SEQ ID NO: 377024 - DNA, 545 bp, Homo sapiens
  misc_feature: GZ8MTXP01CDHXH.3.6.A06.1.454.CMB.2.raw
  modified_base (471)..(471): a, c, t, g, unknown or other
  modified_base (519)..(519): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttacactactggagttggatccggcagtccccagggaggactagagtggtggcatatgcatcacagtgggagccaaccaactaccaaccccctcctcgagaccgtcgagtcaccataatcaatagaacacgtcaaagaaccagttcctccctgagtcttagaagtctagtcaatgctgcggacacggtccggtttatacgttgtgcgtagtactggacggggaaatntctagttgaattagttggggaccaaaggaactagttcggttcaccgtntctcacgccttcaaccgaacggtccc

SEQ ID NO: 377025 - DNA, 527 bp, Homo sapiens
  misc_feature: GZ8MTXP01EFN2M.3.6.A06.1.454.CMB.2.raw
  modified_base (505)..(505): a, c, t, g, unknown or other
  modified_base (509)..(509): a, c, t, g, unknown or other
tcagagacgcactccacgaccggtgctcgatttagatctactgacaggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagtcgttttacactactggagttggatccggcagtccccagggaaggactagagtgggttggccatatgcatcacagtgggagcaaccaactacaacccctcctcgagacgtcgagtcaccataatcaatagaacacgtaccaaagaaccagttactccctgagcttgaaagtctagtcaatgctgcggacacggccggtttattactgtgcgtagtactgacggggaaatatcattgaatagttggggcaaaggacaattggttcacgtntctnagcttccaacgaaggccc

SEQ ID NO: 377026 - DNA, 537 bp, Homo sapiens
  misc_feature: GZ8MTXP01B13CR.3.6.A06.1.454.CMB.2.raw
  modified_base (458)..(458): a, c, t, g, unknown or other
  modified_base (509)..(509): a, c, t, g, unknown or other
tcagagacgcactccacgaccggtgctcgatttagatctactgacagggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagtcgtttttacactactggagttggatccggcagccccagggaaggctagagtggtggcatatgcatcacagtgggagcaacccaactaccaacccctcctcgagacgtcgagtcaccataatcaatagacacgtccaaagaaccagttcctccctgagtcttgaagttctagtcaatgctgcgacacggtcgtttatactgtgcgagtactggacggggaatntcctatttgaattagtttgggggaccaaggaaaccagttcggttcaccgtntctcagccttaccaaccgaacgggtccc

SEQ ID NO: 377027 - DNA, 635 bp, Homo sapiens
  misc_feature: GZ8MTXP01EBVIY.3.6.A06.1.454.CMB.2.raw
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggacgaccctctccctcacctgcactgtctctggtgctcatctagttcgttttacactactggagttggatccggcacgtcccgaagggaaggacgtaggaggtgggtgctatatgcatcacgagtgggacgcaaccaactaccacccctcctcgagtacgtacgagtaccacataactacaatacgacacgtaccaaagaacctagttcctaccctagaacgtcgtaggacgggcttggtacgaacgccggaccgacgaacggaccgaccgggtcgggttagttacgttacgttcggcgcggacgtacgtcgggacccgtacgaaacgacggtaacggtaaccgggtaggacctaaaccgttccgtaaagttcgttacgttttgaactttaacggtcggtaacggggaacccgaaagggttactaacggttcggtaacccg

SEQ ID NO: 377028 - DNA, 763 bp, Homo sapiens
  misc_feature: GZ8MTXP01DU2H2.3.6.A06.1.454.CMB.2.raw
  modified_base (289)..(289): a, c, t, g, unknown or other
  modified_base (310)..(310): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagttcgttttacactactggagttggatccggcacgtccccagggaaggctagnggtgggttgcatatgcatcanagtggagcaaccaactaccacccctcctcgagacgtcgagtccacataacacaatagaaccacgtaccaaagaacctacgttcctccctagaacgtcttagtaagttctagttactaagtcggccttacggaccgggtaaccgtaacccggggtttacccggggttttttaaactttaaccggttgggttaccggtaccgggtaaacggtttaccggttagggggaaaaccggggggtaaaacttaacgttacccgtttaaaggttttcggtaaaagtttttaacggggtttttacgggggggaaaccccttaaaaagggggtaaaacccgtaaaagggtttccggggttaacccttaaaccccgggtttccgttaacccgttttaaccccgaaacccgggtccccctttaccccggtaaaacccggttaaaacccggggggtttcccccccg

SEQ ID NO: 377029 - DNA, 717 bp, Homo sapiens
  misc_feature: GZ8MTXP01AFGEL.3.6.A06.1.454.CMB.2.raw
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagttcgttttacactactggagttggactccggcacgtccccgagggaggactagaggtggtggccatatgcatcacaggtgggagccaaccaactaccaacccctccgtacgagacgtcgagtccacctataactacaatagaccacgtaccaaagtacctagttcctccctagactacgttagaacgttcctaggtacctaaagtcggtccttacgggaccgggaaccgtaccggggttacccgttttaagttaccgttcggtacggtaccggtaacggttacccggttagggaacccggggggtaaactccgttacccgttaaggttttcggtaaaggtttacgggttttacggggggaaaccccttaaaagggggtaacccttaaacggtttccggggttaaccttaccccgggttcttaccgtttaaccgaccgggtaccccttacccgaaacccggttaaacccggggttcccccg

SEQ ID NO: 377030 - DNA, 645 bp, Homo sapiens
  misc_feature: GZ8MTXP01CSKR1.3.6.A06.1.454.CMB.2.raw
tcagagacgcactccacgaccggtgctcgatttagatctactgacagggggggaaatactttctgagagtcctggacctcctgtgcaagaacatgaaacatctgtggttcttccttctcctggtggcagctccagatgtgtcctgtcccaggtgcacctgcaggagtcgggcccaggactggtgacgccttcggacgaccctctccctcacctgcactgtctctggtcgctccatcagttcgttttacactactggagttggactccggcacgtccccgaggggaacggactaggaggtgggttggcctagtatgacatcaacgaggtgggacacaaccgaactaccaacccctcctacgagacgtcgaacgtcaaccataacacaatacgacaaccgtacaaagaccagttcccacctagacgtcttagaacgttctacgtactaagtcgcgtgacggactacgggtcgtttaactacgttgcgtacgaagtcgtacggaacgggggtaaatcgttaccgtagtttaggaagttaaacgggtttgggggaaccgttaaagggtaaaccgtaagttacgggttccttaaccggtttctcctttaacgacccgtccgttaaccgaacccggaaccgggtaaccccg

SEQ ID NO: 377031 - DNA, 705 bp, Homo sapiens
  misc_feature: GZ8MTXP01AE5I6.3.6.A06.1.454.CMB.2.raw
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgcttcggacgaccctctcctcacctgcactgtctctggtgctcatctagttcgttttacactactggagttggatccggcacgtccccagggaggactagaggtgggttggccatatgcatcacaggtggagcaaccaacgtaccaaacccctcctcgagacgtcgagtccaaccataactacgaatacgaacacgtaccaaagtacctagttacctcccgtagacggtccttaggaacgttcgttacgtcctaaatcggtacgttcgacgggacgttaccggggttacctttttaacgttaaccgttggtacggtccggtaagttaccggtacgggtaaaccggggggaaaattcgttacccgttaagtttagggtaacgtttaagggttttaccgggggaaaccgttaaaaggggtaaactaaacgggttcgggttacccgttaccgggttaacctttacgtaaccgttacggacccctttacccggaaaccggttaacccgggggttaacccccg

SEQ ID NO: 377032 - DNA, 643 bp, Homo sapiens
  misc_feature: GZ8MTXP01CLHN4.3.6.A06.1.454.CMB.2.raw
  modified_base (274)..(274): a, c, t, g, unknown or other
  modified_base (325)..(325): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggacgaccctctccctcacctgcactgtctctggtcgctccatctagttcgtttttactactacgtggagttggatccggnacgcccgagggaggactagaggtgggtgcatatgcatcacgaggtaggganaccaaccaactaccaccccctcctacgagtaccgtcgagtccaaccataactacaatacgaaccacgtaccaaacgaaccctgttccctacccgtagaacgtcttagaagttcgtagtactaagtcgacgttcggacggtacgtaccggtttaccggtttaattaccggtggtacggtacgtaagttacgtagggaaacggggtaaactcgttaccgtagtttgaagtttaggttacggggaaccaaaggtaaacctgttaccggttcttaccgttctacttaaccgactcccttaccgaaccggttaacgggtcccc

SEQ ID NO: 377033 - DNA, 702 bp, Homo sapiens
  misc_feature: GZ8MTXP01AOVR5.3.6.A06.1.454.CMB.2.raw
  modified_base (553)..(553): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggacgaccctctccctcacctgcactgtctcggtgctccatctagttcgtttttactactacgtggtagttggatccggcacgtcccgagggaggactagagtgggtgcatatgcatcgacaggtggacgcaaccaaacgtaccaacccctcctacgagacgtccgagtcaaccatactacaaatcgaactacgtaccaaacgaacctacgttcctaccctagacgtacgttagaacgttctagtacgaaagttcgacgttacggaccggtaacgtaccggggttacctttttaaacggttaccggttgggttacggaccggttaacggtaaccggttaggggaacgggggttaaaaacncgttaaccgttaagttttacggtaaagtttaacgggtttaacgggggaaacccgtaaaggggttaaacctaaaggttcgggttacccaccggtttcctcgttacgaacgtccccgtacccgaaccggtaaccgggttccctaacccggg

SEQ ID NO: 377034 - DNA, 661 bp, Homo sapiens
  misc_feature: GZ8MTXP01BX9T1.3.6.A06.1.454.CMB.2.raw
  modified_base (328)..(328): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctcatctagttcgttttactactacgtggagttggactccggcacgtccccgaagggaaggactaggaggtgggttcgcatatgcatcacgaggtggganaccaaccaactaccaacccctcctacgagacgtcgagtacaccataacacaatacgacacgtaccaaacgtaacagttcctacctgacgtctagaacgtctagtacaagtcgctcgacggtacgtaccgggttcgtttaattaccggtgtacggtacgtaagttacggtacgggtaaacgggggtaaatacgttaccgtaagtttcggaaagtttaacgggtttacgggggaaaccgttaaaaggtaaacgtaacgttcgggttaccttacccgggttcttacgttaaccgaccggtcccttaacccgaacccggttaacggggtaacccccg

SEQ ID NO: 377035 - DNA, 616 bp, Homo sapiens
  misc_feature: GZ8MTXP01C8US5.3.6.A06.1.454.CMB.2.raw
  modified_base (334)..(334): a, c, t, g, unknown or other
  modified_base (521)..(521): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagttcgggcccaggactggtgacgccttcggacgaccctctccctcacctgcactgtctcgtggtcgctccatctagttcgttttactactacgtggagttggactccggcacgtccccgaagggaagggactaggaggtgggtggcatatgcatcacgaggtgggacnccaaccaactaccaaccccctccacgacgacgtacgagtcaaccataactacaatagaaccacgtaccaaacgacctagttcctccctagacgtctagaagtctgtacaatgactaggcggtaacgaccgggttacggttttaactacgtggtcgacgtacgttacgtacgggaacggggtaaactntaccgttaagtttgtaacgttaggtttacggggacttaaaggaaactagttcggttcttaccgtctctcgacgcccttaccaaccgaacggtccc

SEQ ID NO: 377036 - DNA, 578 bp, Homo sapiens
  misc_feature: GZ8MTXP01A4AW2.3.6.A06.1.454.CMB.2.raw
  modified_base (315)..(315): a, c, t, g, unknown or other
  modified_base (335)..(335): a, c, t, g, unknown or other
  modified_base (353)..(353): a, c, t, g, unknown or other
  modified_base (391)..(391): a, c, t, g, unknown or other
  modified_base (466)..(466): a, c, t, g, unknown or other
  modified_base (544)..(544): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctcatcagttcgtttttacactactggagttggatccggcagtccccagggaaggctagagtggtggcatatgcatcacagtgggancaccaactaccaaccctccncgagacgtcgatcgaccntaactcaagtagacacgtccaagaccagtcctaccctnagcttgaagttctagctaaatgactcgacggacgacggtcccggtttaattaccgtgtagaccgagttaaccggngggaacgggaaatcgtacgttagttggtaagttaggttacgggaaacaaagggaactaaggttcggttcttacccgtntccttcgacgtcccttacgtaaccgaacggtccc

SEQ ID NO: 377037 - DNA, 550 bp, Homo sapiens
  misc_feature: GZ8MTXP02GRKIF.3.6.A06.1.454.CMB.2.raw
  modified_base (362)..(362): a, c, t, g, unknown or other
  modified_base (463)..(463): a, c, t, g, unknown or other
tcagagacgcactccacgaccggtgctcgatttagatctactgacaggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagttcgtttttacactactggagttggatccggcagtccccagggaagggactagagtgggtggccatatgcatcacagtgggagcaccaactaccaacccctcctcgagacgtcgagtcaccatancatagacacgtaccaagaaccagttctccctgacgcttagaatctgcaatgctgcgacacggtccgtttattactgtgacgagtacgtggacggggaaaantaccgtatttgattagtttagggggacctaaagggaacaagtcggtaccaccgtctacttacacgccctaccaccgaacggtacccc

SEQ ID NO: 377038 - DNA, 695 bp, Homo sapiens
  misc_feature: GZ8MTXP02G1NUR.3.6.A06.1.454.CMB.2.raw
tcagagacgcactccacgaccggtgctcgatttagatctactgacaggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttactactactggagttggatccggcagtccccagggaggactagagtggtgcatatgcatcacagtggagcaccaactacaaacccctcctacgagacgtcgagtcaccatatacatacgacacgtaccaaagaacctagttacctccctagacgtcctttagaaagttcctagtaccaaagttcgacgttaggaccgggtaacgtaccgggttacccgttttaagtttaacgtcggtttacggaccggtaacggttaccgttacggggaaaccggggggtaaaatacgttcccgttaaaagttttacggtaaagtttaacggggttttacgggggaaaccccgtaaaaagggggtaaaacccttaaagttacgggggtaccctaaacccgggttccttaccgtttaccgacggtaccccttacccgaaacccggtaaccggggtaccccc

SEQ ID NO: 377039 - DNA, 622 bp, Homo sapiens
  misc_feature: GZ8MTXP02GMENM.3.6.A06.1.454.CMB.2.raw
tcagagacgcactccacgaccggtgctcgatttagatctactgacaggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggacgaccctctccctcacctgcactgtctctggtgctccatcagttcgttttactactactggagttggatccggcacgtccccgagggaaggactaggaggtgggttggccatatgcatcacaggtgggagccaaccaactaccaaacccctcctacgagaccgtcgagtacacctatactacataacgacacgtaccaaagaacctagttcctaccctgacgtcttagaagttcctagtcaagttcgcgtcggacggaccgtaccgggtaccgttttattacgttgtaggacgtaagtacgtgggaacgggggaaaatacttccgtaagtttgaagtttaggtttacgggggaacctaaaggggaaactaacgtcggtacctaccggttcgtcttaccacgtccctaccgaaccgacggggtacccc

SEQ ID NO: 377040 - DNA, 618 bp, Homo sapiens
  misc_feature: GZ8MTXP02HL214.3.6.A06.1.454.CMB.2.raw
  modified_base (322)..(322): a, c, t, g, unknown or other
  modified_base (362)..(362): a, c, t, g, unknown or other
tcagagacgcactccacgaccggtgctcgatttagatctactgacaggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagttcgttttactactactggagttggatccggcacgtccccagggaagggactaggagtgggtgccatatgcatcacgagtgggancaccaactacaacccctcctcgagcgtcgagtcaccatancatacgacacgtaccaaagaaccagttcctccctagacgtcgttagaacgttctagtaccaaatcgcgttcgaccggtacgaccggttccgttttaagtttaccgtggttacggacgtagttacgtaggacgggggtaaagacttaccgtagtttaggaacgttaggtttcgggggaaccaaagggtaaccaaaggttcggtactacccggtcttaccgttacacggtccctacccgaaccgaaccgggtaccccg

SEQ ID NO: 377041 - DNA, 557 bp, Homo sapiens
  misc_feature: GZ8MTXP02G7SFH.3.6.A06.1.454.CMB.2.raw
  modified_base (314)..(314): a, c, t, g, unknown or other
  modified_base (431)..(431): a, c, t, g, unknown or other
  modified_base (443)..(443): a, c, t, g, unknown or other
  modified_base (456)..(456): a, c, t, g, unknown or other
tcagagacgcactccacgaccggtgctcgatttagatctactgacaggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagttcgttttacactactggagttggatccggcagtccccagggaagggactagagtggtgcatatgcatcacagtggancaccaactacaaacccctcctcgagagtcgagtcaccatatacatagacacgtaccaaagaaccagttctccctgagctagaatctgtcaaatgctgcgacacgccgtttaattacngtgcgaagtacnggacgggaaaagntaccattagagttaagtttgggggaaccaaagggaaaccaaagtcgggttaccaaccggttcgtaccttacacgaccctaccaacccgaacggggaccccc

SEQ ID NO: 377042 - DNA, 552 bp, Homo sapiens
  misc_feature: GZ8MTXP02IMADU.3.6.A06.1.454.CMB.2.raw
  modified_base (320)..(320): a, c, t, g, unknown or other
  modified_base (366)..(366): a, c, t, g, unknown or other
  modified_base (439)..(439): a, c, t, g, unknown or other
  modified_base (519)..(519): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggacgaccctctccctcacctgcactgtctctggtgctccatctagttcgtttttacactactggagttggatccggcacgtcccagggaggactagagtgggtgccatatgcatcacaggtgggancaaccaactaccaacccctctcgagacgtcgactcacatatcatanacacgtaccaaacgaccagttcccacctgatctagagtctgacaatgactgcggactacggtcctttaatcgngtacgcgtagacgtggaacgggaatctacgtattgattaggttgggaacctaaaggaactacgtacgtaccgtaaccgtnttcgttacacgtcctaccgaacggacggtaccc

SEQ ID NO: 377043 - DNA, 629 bp, Homo sapiens
  misc_feature: GZ8MTXP02HY8NZ.3.6.A06.1.454.CMB.2.raw
  modified_base (311)..(311): a, c, t, g, unknown or other
  modified_base (318)..(318): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagttcgtttttacactactggagttggatccggcacgtcccgagggaggactagaggtgggtgcatatgcatcacngtgggancacaactaccaacccctccctcgacgacgtcgacgtcaacctatactacatacgactacgtaccaaagaaccagtttcctccctagacgtcttaggaaacgttcttagtacaaattcgacttggccggaacgtaccgggttccgttttaattacgtggtaggaccgtaggtacgtagggacggggaaagtactacgtagtttagaacgtttaaggtttcgggggaacctaaaaggggtaaacctaaggttacgggtaccctaaccggttcgttaccttacgaccgtcccttaccgaaccgtaacgggcccc

SEQ ID NO: 377044 - DNA, 734 bp, Homo sapiens
  misc_feature: GZ8MTXP02I0G7H.3.6.A06.1.454.CMB.2.raw
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagttcgttttacactactggagttggatccggcagtccccagggaggactagagtgggttgccatatgcatcacagtggagcaccaactaccaaccccacctcgagacgtcgagtcaccatactcatagatacgtaccaagaacctagttcctaccctgacgtaccgtttaggaaaacggttcccttaggtaccctaaaagttcggaccgttacgggaccggggtaaaccggtaacccggggtttaccccggtttttaaacggtttaacccttagggttcgggtacccggtaacggttaaaccggttcggggtaaacccggggggtaaaaagtacgtttacccgtaaagtttttcggtaaaagtttacggtttttaacgggggggaaccctaaaaggggtaaaccgttaaagtacgggggttaccctaaacccggtttccttccgttttacgaaacccggtccctttaaccccgaaccggtaaaccggggttaaccccc

SEQ ID NO: 377045 - DNA, 549 bp, Homo sapiens
  misc_feature: GZ8MTXP02I4YFG.3.6.A06.1.454.CMB.2.raw
  modified_base (465)..(465): a, c, t, g, unknown or other
tcagagacgcactccacgaccggtgctcgatttagatctactgacaggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagttcgtttttacactactggagttggatccggcagtccccagggaaggactagagtgggtggccatatgcatcacagtgggagcaccaactaccaacccctccctgacgacgtcgagtcaccatatcatagacacgtccaaagaaccagttcctccctgagcttagaagtctagtcaatgactgcgactacggtcgtttaattctagtgacgagtactggacggggaaantacctatttgagttagtttggggacctaaagggaactagtcggtacaccgttctcttacgacgtccctaccacgaacggtcccc

SEQ ID NO: 377046 - DNA, 618 bp, Homo sapiens
  misc_feature: GZ8MTXP02H2DIJ.3.6.A06.1.454.CMB.2.raw
  modified_base (322)..(322): a, c, t, g, unknown or other
tcagagacgcactccacgaccggtgctcgatttagatctactgacaggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctcggtgctcatcagttcgtttttactactacgtggagttggactccggcacgtccccgaggagggactagagtgggttggccatatgctatcacaggtggancgaaccaactacgaacccctccctacgacgacgtccgagtccaccgatatacgaaatcgaactacgtacccaaagaacctagtcctacccgtgagtccttagaacgttcctagtacaaagttcgactggacggacctacgggttacctttattaccgtgtacgaccgtagtacgtacggacggggtaaatcttaccgtagtttgaaagtttaggttcgggaaacgaaacggtaaacaaggttcgacctaccggttacttaaccgttcaacgtccctacaccgaacggtcctaccgg

SEQ ID NO: 377047 - DNA, 719 bp, Homo sapiens
  misc_feature: GZ8MTXP02FT9KU.3.6.A06.1.454.CMB.2.raw
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatctagttcgttttactactacgtggagttggatccggcagtccccagggaaggactagaggtgggttggcatatgcatcacaggtgggagccaaccaactaccaaccccctcctacgagacgtcgacgtcaaccatactacatacgaacacgtaccaaacgtaacctagtttaccctccctagagtaccgttagaaacgttctacgtactaaagtcgtctacgggaccgggtaaacgtacccgggtaccgtttttaacgttaaccgtttggttacggtaccggtaaggttacggttacggggaacggggggtaaaaactacgttacccgttaaaggtttttacgaaaggtttacgggttttacggggggaacccgtaaaaagggtaaaccgtaaaggttacgggtaccctaaacccggttccgttaccgtttaaccgaacgttcccccgttaaacccgaacccggaaaaccgggggttacccccg

SEQ ID NO: 377048 - DNA, 627 bp, Homo sapiens
  misc_feature: GZ8MTXP02GGABR.3.6.A06.1.454.CMB.2.raw
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctcatcagttcgttttactactactggagttggatccggcacgtccccaggggaagggactaggaggtgggttggccatatgcatcactaggtgggacgcaaccgaactacccaacccctccgtacgagacgtcgacgtcaccatactacatacgacacgtaccaaagtaacctagttcctacccgtagacgtcttaggaaattcttgtacaaagtgctacggccggaacgtacggttaccgttttaatacgtgtacggacgtacggtaccgtagggaacgggggtaaatcgttaccgtaagtttgaagtttacggtttggggaacctaaaggaactacgtcggtactaaccggttctaccgttacgaccgtaccctaccgaaccggtacggtaccccg

SEQ ID NO: 377049 - DNA, 702 bp, Homo sapiens
  misc_feature: GZ8MTXP02HHP9F.3.6.A06.1.454.CMB.2.raw
  modified_base (330)..(330): a, c, t, g, unknown or other
  modified_base (383)..(383): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggacgaccctctccctcacctgcactgtctctggtgctccatctagttcgtttttacactacgtggtagttggactccggcacgtccccgagggaggactagaggtgggtgacatatgacatcacgaggtggggacnccgaaccaactacccaaaccccctcctaggacgaccgtcgacgtccaacatanacatacgacaccgtacaaacgtaccctagttaccctcccgtagaacgtcgttaggtaaactccgttagaccctaatacggccgttacgaccgggtaacggaaccggtttaccgtttactttaaccggtggtacgggtacctaagggttacgtaggggtaaacgggggaattaccgtacgttaagtttaggtaaaggtttacgggtttacgggggaaaacctaaagggtaaaaccgtaggttacccggtacgttacccggttaacgttaccgtttaccaccggtaccccttaacccgaacccggtaaacggttccccccg

SEQ ID NO: 377050 - DNA, 787 bp, Homo sapiens
  misc_feature: GZ8MTXP02H73HQ.3.6.A06.1.454.CMB.2.raw
tcagagacgcactccacgaccggtgctcgatttagatctactgacagggggggaaaatactttctgagagtcctggacctcctgtgcaagaacatgaaacatctgtggtttcttccttctcctggtggcagctcccagatgtgtcctgtccaggtgcacctgcaggagtcgggccaggactggtgacgccttcggacgaccctctccctcacctgcactgtctcgtggtgctcatctagttcgtttttacactacgtggtagttggacgtccggcacggtcccgaagggaacgggactaggtaggtgggttacggacctagtagtgacagtaccgaacgtaggtacgggacgacccaaacccgtaaaccgtaaaccccaaaccccccgttccccgtacggtaacggtaccccgtaccggtaaccgttacccaaccgtaacgttaactaaacctaacgttaaccggaaacctaaacccggtaaccctaaaaccggtaacccttaaacgttttccctaccccgtagggtaacgttcgttaaggtaaaccgttcgttacgtaacgaagttcggcgttacgggaaccggtaacgttaccggtttaccgttttaaactttcggtaggtacggtacgggtaagtttaccgggtagggggtaaacgggggaaaacttaccgttacgttagtttacggtaaggttacggtttacggggaactaaaagggtaactacggttcgtaccgaccgtttcgtacttaccggactccctaaccggacgtaacccggtcccg

SEQ ID NO: 377051 - DNA, 580 bp, Homo sapiens
  misc_feature: GZ8MTXP02FNNET.3.6.A06.1.454.CMB.2.raw
  modified_base (366)..(366): a, c, t, g, unknown or other
  modified_base (386)..(386): a, c, t, g, unknown or other
  modified_base (436)..(436): a, c, t, g, unknown or other
tcagagacgcactccacgaccggtgctcgatttagatctactgacaggggggaaatactttctgagagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgtactgtctctggtgctccatccgtcttactactggagctggctccggcacgcccccagggaaggactgggagcatattgggtatgtctttcacagtgggaggctgactacaacgcctcctacaggagtcgggtccaccataatcagtagacncgtccaaagacgccagttcnccctagaaagctgagggctgtgagcgcgcagacacgggcctgtattacgngtgcggagacgtggaccgacgaaacacgaacgtaacgggtcgggaaccaaaccgttccttaaagtcggtacctttttagggacttaagttcgtaacgggggacccaaaagggggacctaaagtcgggtaccaaaccggtttccg

SEQ ID NO: 377052 - DNA, 659 bp, Homo sapiens
  misc_feature: GZ8MTXP02JAI9S.3.6.A06.1.454.CMB.2.raw
  modified_base (311)..(311): a, c, t, g, unknown or other
  modified_base (315)..(315): a, c, t, g, unknown or other
  modified_base (323)..(323): a, c, t, g, unknown or other
  modified_base (447)..(447): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtccgggcccaggactggtgacgccttcggagaccctctccctcacctgcactgtctctggtgctccatcagttcgttttacactacgtggagttggactccggcacgtcccgagggacggactagagtgggttcgcatatgcancacnggtgggancaaccaactaccacccctccgacgacgtacgtcgacgtacaacctatactacatacgacaccgtaccaaacgaaacctgtttaccctaccctagtactcgttagaactctgtacaagtcgtacncggtacggaccgtacgggttacccttttattacgacggttagaccggtaagttcggtacggggaacgggtaaacgtacttaccgtagtttaggtaaggtttacgggtttacggggggaaaccctaaaggtaaaaccgtaggttacggtacctaccggtaaccgtttcgttaccaccgttaccctacccgaaaccggacccgggttaaccccg

SEQ ID NO: 377053 - DNA, 620 bp, Homo sapiens
  misc_feature: GZ8MTXP02FTTJJ.3.6.A06.1.454.CMB.2.raw
  modified_base (312)..(312): a, c, t, g, unknown or other
  modified_base (442)..(442): a, c, t, g, unknown or other
tcagagacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagttcgttttactactactggagttggactccggcacgtaccccgagggaacggactaggaggtgggtgcctatangacatcgacgaggtgggacaccaacctaaacctaccccaacccctccgtacgacgtaccgtacgtacgtacactatacacactacgactacgtaccaacgaactacttacctcctagactactagacgtntacgactaagtcgcgtacgacgtacgtacggttacttatacgtgtcggacgtacgtacgtagggaacggggtaaatcgtacgtagttagtacgttagggtacggaacgtaaacgaacgtacgttacggtacctaccgttcgtacctacgtacccgtcctaccgaccgacggtaccccg

SEQ ID NO: 377054 - DNA, 491 bp, Homo sapiens
  misc_feature: GZ8MTXP01EBHVC.11.86.H09.1.454.CMB.2.raw
  modified_base (353)..(353): a, c, t, g, unknown or other
  modified_base (416)..(416): a, c, t, g, unknown or other
  modified_base (464)..(464): a, c, t, g, unknown or other
  modified_base (485)..(491): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaaccgccccaaactcctcatctatagtaataatcagcggccctcaggggtccctgaccgattctctggctccaagtctggcacctcacgccctccctggccatcagtggctccagtctgatgatgagctgattatactgtgcagcatgggatgaacnccctgatggtccttgtgtggtttcgcggaggacaagctgaccgtctaggtcacgcccaagccncgcccctggtcactctcgttccccgccctcctcgtactctctcgctgngcggcttggcaggcgcattgnnnnnnn

SEQ ID NO: 377055 - DNA, 508 bp, Homo sapiens
  misc_feature: GZ8MTXP01ELJ7C.11.86.H09.1.454.CMB.2.raw
  modified_base (502)..(508): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaaccggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgaacaccctgaatggtccttgtgttgggttttcggcgggtagggaccaagctgaccgtctaggtcagcccaaggcctcgccccctcggtcactctcgttccccacctcctcgtatcctctcgctgcgcgggcttgggccaaggcgcagttnnnnnnn

SEQ ID NO: 377056 - DNA, 505 bp, Homo sapiens
  misc_feature: GZ8MTXP01DBEX6.11.86.H09.1.454.CMB.2.raw
  modified_base (382)..(382): a, c, t, g, unknown or other
  modified_base (477)..(477): a, c, t, g, unknown or other
  modified_base (499)..(499): a, c, t, g, unknown or other
  modified_base (501)..(505): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactccaggaacgccccaaatcctcatctatagtaataaatcagcggcctcaggggtccctgaccgattctctggctccaagtctggcacctcagcctccctggccatcagtgggctccagtctgatgatgaggctgattagttactgtgcagcatggggatgaacaccctgaatggtccttgtgtggtttcgggnggtaggaccaagctgaccgtctaaggtcacgcccgaaggcctcgccccctcggtctacgtcctcgttcccaccctcctctactcctctcgctcgngcggcttggcaaggcgcttagngnnnnn

SEQ ID NO: 377057 - DNA, 507 bp, Homo sapiens
  misc_feature: GZ8MTXP01ECH01.11.86.H09.1.454.CMB.2.raw
  modified_base (475)..(475): a, c, t, g, unknown or other
  modified_base (493)..(493): a, c, t, g, unknown or other
  modified_base (498)..(507): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggccccccaaactcctcatctatagtaataatcagcgccctcaggggtccctgaccgattctctggctccaagtctggcacctcagcctccctggccatcagtgggctccagtctgatgatgaggctgattattactgtgcagcatgggatgaacaccctgatggtccttgtgttgggtttcgggcggtagggacaagctgaccgttctaggtcacgcccaaggcctcgcccctggccactctccgtccccaccctcctcgtactcctctcgctgnggcggcttggcaggcgcngttgnnnnnnnnnn

SEQ ID NO: 377058 - DNA, 498 bp, Homo sapiens
  misc_feature: GZ8MTXP01B78X1.11.86.H09.1.454.CMB.2.raw
  modified_base (356)..(356): a, c, t, g, unknown or other
  modified_base (469)..(469): a, c, t, g, unknown or other
  modified_base (486)..(486): a, c, t, g, unknown or other
  modified_base (488)..(488): a, c, t, g, unknown or other
  modified_base (490)..(490): a, c, t, g, unknown or other
  modified_base (492)..(498): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgatttattactgtgcagcatgggatgaacnccctgatggtccttgtgttgggtttcggcggaggccagctgaccgtctaggtcacgcccaggctcgcccctcggtcactctcgttccccgccctcctcgtactctctcgctgngcgggcttgggcaggcncngngnnnnnnn

SEQ ID NO: 377059 - DNA, 586 bp, Homo sapiens
  misc_feature: GZ8MTXP01BDUZQ.11.86.H09.1.454.CMB.2.raw
  modified_base (290)..(290): a, c, t, g, unknown or other
tcagcgagagataccacgaccggtgctcgatttagtgctatagacttgggtttggggttgaaattgctgttcccagtgtaatcgatatacccaatccactccagaccctgtccctcacctgcactgtctctggtgcctccatcagtagttattactggagctggatccggcagcccccagggaaggactggagtggattgggtatatcgattacactgggaacagcaatttccaaccccgcctcaagagtcgagtcaccatatcagtagacacgtccaagaaccacttcnccctgaggctgacctctgtcgaccgctgtggacacggccgtctattactgtacgagataccaaatgattacatcgactggttccgacccgtggggccaggggaccctggtccacgtctctcacgcctccaccgaacgggcccacgtccggttcccttccccgtcggccctacccggtccctaccgaacgacgccacccgtcgtcgggggccacgacgccggccgtgggcctcgccgtcggttacgaacggtcttaccgttccgttactcctcgtcgcgtcggcggtcggcgtcggg

SEQ ID NO: 377060 - DNA, 500 bp, Homo sapiens
  misc_feature: GZ8MTXP01DVBJ3.11.86.H09.1.454.CMB.2.raw
  modified_base (472)..(472): a, c, t, g, unknown or other
  modified_base (492)..(492): a, c, t, g, unknown or other
  modified_base (494)..(500): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtcccctgaccgattctctggctccaagtctggcacctcagcctccctggccatcagtgggctccagtctgatgatgaggctgattattactgtgcagcatgggatgaaccacctgaatggtccttgtgtggttttcggcggtagggaccaagctgaccgtctaggtcagcccaagctcgcccctcggtcactctcgttccccaccctcctcgtactctctcgctgngcgggcttggcaggcgcagngnnnnnnn

SEQ ID NO: 377061 - DNA, 621 bp, Homo sapiens
  misc_feature: GZ8MTXP01ERRXJ.11.86.H09.1.454.CMB.2.raw
  modified_base (249)..(249): a, c, t, g, unknown or other
  modified_base (532)..(532): a, c, t, g, unknown or other
  modified_base (540)..(540): a, c, t, g, unknown or other
  modified_base (569)..(569): a, c, t, g, unknown or other
  modified_base (607)..(608): a, c, t, g, unknown or other
  modified_base (617)..(617): a, c, t, g, unknown or other
tcagcgagagataccacgaccggtgctcgatttagtgctatagacttgggtttggggttgaaattgctgttcccagtgtaatcgatatacccaatccactccagaccctgtccctcacctgcactgtctctggtgcctccatcagtagttattactggagctggatccggcacgcccccagggaaggactggagtggattgggtatatcgattacactgggaacagctaatttccaacccgcctcaagngtcgagtcaccatatcagtagacacgtaccaagaacctacttctccctgacggctgaccctctcgtcgaccgtctggtacggaccgaccggcccgtttactaacgtttactcggttaacgagtaactaccccaaaagttgtaaacttaacactaacggtaacttcgggttacccggaaccccgttgggggacccaacggggtaacccctgggtacccaccgttctaccctcacgccctacgaccgacgggccacgtcggtcccttccccggcccacccgttcncaaagccnccgcgtcggcggccacgtcggccggccgnggctcgcgtcgacgacgtcttacgttccgatctcgcgnngcggtcggngtcg

SEQ ID NO: 377062 - DNA, 504 bp, Homo sapiens
  misc_feature: GZ8MTXP01AJW33.11.86.H09.1.454.CMB.2.raw
  modified_base (474)..(474): a, c, t, g, unknown or other
  modified_base (496)..(504): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcagggggtccctgaccgattctctggctccaagtctggcacctcagcctccctggccatcagtggctccagtctgatgatgaggctgattattactgtgcagcatgggatgaacaccctgatggtccttgtgttggtttcggcggagggacagctgaccgtctaggtcagccccaaggcctcgccccctcggtcactccgtcgttccccaccctcctcgtactctctcgctggngtcgggcttgggcaggcgcagnnnnnnnnn

SEQ ID NO: 377063 - DNA, 642 bp, Homo sapiens
  misc_feature: GZ8MTXP01ESZZ3.11.86.H09.1.454.CMB.2.raw
  modified_base (292)..(292): a, c, t, g, unknown or other
  modified_base (634)..(642): a, c, t, g, unknown or other
tcagcgagagataccacgaccggtgctcgatttagtgctatagacttgggtttgggggccgttcctgggcccagtctgtgctgactcagcccaccctcagcgtctcggggacccccgggcagagggtcatcatctcttgttctggaagcagctctaatatcggaagtaatactgtaaaattggtatcaacaactcccaggaaccgcccccaaactcctcatctatagtaataatcagccgccctcgacggggtccctgaccgtattctctggctcaagtctggcacctcacncctccctggccatcagtggctcagtctgatgatgaggcttgtatttattacgtgtgctacgctagtggggatacgaacctaacccgtgtaaacgttcgggttccctttggggttcgggttttcgggggtttttaccgggacgggggtacggggtaacccgaaggtccgtacggtacccgttaccgtaacggtccgaacggcccccgaaggggtcccctccggccccccgttcggtaccctaccgtttccgttccccgttcccccgtcccctttcccgtaccgttcgttccctcgtccgcgtgggcgtcggggccgttgggcttaacgggcgcgttagttggnnnnnnnnn

SEQ ID NO: 377064 - DNA, 505 bp, Homo sapiens
  misc_feature: GZ8MTXP01A6IX5.11.86.H09.1.454.CMB.2.raw
  modified_base (296)..(296): a, c, t, g, unknown or other
  modified_base (322)..(322): a, c, t, g, unknown or other
  modified_base (497)..(505): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaaccggcccccaaactcctcatctatagtaataatcagcggccctcgacggggtccctgaccgtattctctggttccttgtctgacacctcagcctcccnggccatcactggctccagcctgaggntgaggctgattattactgtcagttcctttgacctattaaactggatgtggtattcgggcggagggactaagctgaccgtctaagtcagcccaagcctcgccccctcggtcactctcgtccccaccctcctcggtactctcctcgctggcgcgggctcggcgaaggccgcaatagnnnnnnnnn

SEQ ID NO: 377065 - DNA, 615 bp, Homo sapiens
  misc_feature: GZ8MTXP01A05R2.11.86.H09.1.454.CMB.2.raw
  modified_base (602)..(602): a, c, t, g, unknown or other
  modified_base (604)..(605): a, c, t, g, unknown or other
  modified_base (608)..(611): a, c, t, g, unknown or other
  modified_base (613)..(613): a, c, t, g, unknown or other
  modified_base (615)..(615): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaaccgccccaaactcctcatctatagtaataatcagcgcctcgacggggtccctgaccgattctctggctccaagtctggcacctcacgcctccctggccatcagtggctccagtctgatgatgaggctgattattactgtgcagcagtgggatgaaaccaccctgaaagttggttcccgtttggtcggttcggggttttcgggacgggtacgggacctaaggccgtacggacccggttccgttacgggtaccacggaccccgaaacgggccctacccggcccccttccgggtcctaaccgttccgttccggttccccctcccttcccgttccggtacttcctccgtccgacgttcggacgggtccgggtcttcggggaccgaaacgggtccggacttacgacggngnncgnnnngngn

SEQ ID NO: 377066 - DNA, 565 bp, Homo sapiens
  misc_feature: GZ8MTXP01CPM77.11.86.H09.1.454.CMB.2.raw
  modified_base (528)..(528): a, c, t, g, unknown or other
  modified_base (536)..(536): a, c, t, g, unknown or other
  modified_base (556)..(565): a, c, t, g, unknown or other
tcagcgagagataccacgaccggtgctcgatttagtgctatagacttgggtttggggccgttcctgggcccagtctgtgctgactcagccaccctcagcgtctgggacccccgggcagagggtcatcatctcttgttctggaagcagctctaatatcggaagtaatactgtaaattggtatcaacaactccaggaacgccccaaatcctcatctatagtaataatcagcggccctcgaggggtccctgaccgattctctggctccaagtctggcactcagccctccctggccatcagtggctccagtctgatgatgaggctgatttattactgtgcagtcaagtggggatggaacctacccgtgaaacttgggttccctttgggtggttgggttttcgggcgggaacgggtaccgaaggcctcggacccgttaccgtaggttccacggacccgaaggcccgtacggccccctcggtcctaccttccgttccttccccgaccctccctcgtactcctccgtccgctcgnggtccggnttcggcaaggccgcagttgnnnnnnnnnn

SEQ ID NO: 377067 - DNA, 493 bp, Homo sapiens
  misc_feature: GZ8MTXP02HH44X.11.86.H09.1.454.CMB.2.raw
  modified_base (487)..(493): a, c, t, g, unknown or other
tcagcgagagataccacgaccggtgctcgatttagtgctatagacttgggtttggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtggctccagtctgatgatgaggctgattattactgtgcagcatgggatgacaccctgaatggtccttgtgtggtttcggcggtagggaccaagctgaccgtctaggtcagcccaaggctcgcccctcggtcactctcgtcccaccctcctcgtatctctcgctgacgcggctggcaaggcgcatagnnnnnnn

SEQ ID NO: 377068 - DNA, 499 bp, Homo sapiens
  misc_feature: GZ8MTXP02I9E9R.11.86.H09.1.454.CMB.2.raw
  modified_base (490)..(499): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcccctatgacgacgacctacagtctccgggtttcggcggagggactaagctgaccgtctaagtcagcccaaggctcgccccctcggtcactctcgttccccaccctcctcgtactctctcgctgagcggctggcaaggcgcatgnnnnnnnnnn

SEQ ID NO: 377069 - DNA, 491 bp, Homo sapiens
  misc_feature: GZ8MTXP02H2CIC.11.86.H09.1.454.CMB.2.raw
  modified_base (332)..(332): a, c, t, g, unknown or other
  modified_base (337)..(337): a, c, t, g, unknown or other
  modified_base (468)..(468): a, c, t, g, unknown or other
  modified_base (482)..(482): a, c, t, g, unknown or other
  modified_base (484)..(491): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactccaggaacggccccaaatcctcatctatagtaaataatcagcggccctcaggggtccctgaccgattctctggctccaagtctggcacctcagcctcctggccatcagtggctccagtctgatgatgagctgattatactgngcagnatggatgacacctgaatgtccttgtgtgggtttcgcggaggaccaaagctcgaccgtcctaggtcagcccaaggctcgccccctggtcactctcgtcccaccctcctcgtactctctcgctgacgcgggcnggcaagggccacanannnnnnnn

SEQ ID NO: 377070 - DNA, 547 bp, Homo sapiens
  misc_feature: GZ8MTXP02HFTTB.11.86.H09.1.454.CMB.2.raw
  modified_base (338)..(338): a, c, t, g, unknown or other
  modified_base (353)..(353): a, c, t, g, unknown or other
  modified_base (356)..(356): a, c, t, g, unknown or other
  modified_base (537)..(547): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaaccggcccccaaactcctcatctatagtaataatcagcggccctcaggggtccctgaccgattctctggctccaagtctggcacctcagcctccctggccatcagtggctccagtctgatgatgaggctgattatactgtncagcagtggatgacnccngatgtcttgtgttggtttcggcggtaggactagctcggacccgtcgtaggtccacgcccgaaggtcctccgcccccgtcggttccaccgtttcctccggttcccccgcccttcccgttacgtcttcccgcccgtcgtaacggcggcccgggtcgtcgggacgaacgggcaccgtagtacgnnnnnnnnnnn

SEQ ID NO: 377071 - DNA, 560 bp, Homo sapiens
  misc_feature: GZ8MTXP02JWGOD.11.86.H09.1.454.CMB.2.raw
  modified_base (316)..(316): a, c, t, g, unknown or other
  modified_base (544)..(544): a, c, t, g, unknown or other
tcagcgagagataccacgaccggtgctcgatttagtgctatagacttgggtttggggttgaaattgctgttcccagtgtaatcgatatacccaatccactccagaccctgtccctcacctgcactgtctctggtgcctccatcagtagttattactggagctggatccggcagcccccagggaagggactggagtggattgggtatatcgattacactgggaacagcaattcaaccccgccctcaagagtcgagtcaccatatcagtagacacgtccaagaaccacttctccctgaggctgacctctgtgacccgntggtggacacggccgtctatactgtacgagatccaaatgattacatcgactgggttccgacccctgggggcccaggggaaccctggtccaccgtctcctcacgccctccaccaacgggcccatccggtcctcccccgtcggccaccctccgtaccagacgccacctcgtcgggggcacacgcggccctgggctcgccgtcggtcaacggtcctacttccgatccgtcncgctgcgtcggctcgg

SEQ ID NO: 377072 - DNA, 535 bp, Homo sapiens
  misc_feature: GZ8MTXP02H5MDE.11.86.H09.1.454.CMB.2.raw
  modified_base (526)..(535): a, c, t, g, unknown or other
tcagcgagagataccacgaccggtgctcgatttagtgctatagacttgggtttggggccgttcctgggcccagtctgtgctgactcagccaccctcagcgtctgggacccccgggcagagggtcatcatctcttgttctggagcagctctaatatcggaagtaatactgtaaattggtatcaacaactccaggaacggccccaaatcctcatctatagtaataatcagcggccctcgacggggtccctgaccgattctctggctccaagtctggcacctcagcctccctggccatcagtggctccagtctgatgatgaggctgattattactgtgcagcagtgggatcgacacctgaattgtccttgtgtggtttcggcggagggaccagcgtcgaccgtccgtaggtccacgacccgaaggccgtcgcccccgtacggtcctaccgttccttcgttccccgtccccgttcctccgtacttcctctccgtcgtcgacggtcggcgtgggaccaagggcgcagtagnnnnnnnnnn

SEQ ID NO: 377073 - DNA, 491 bp, Homo sapiens
  misc_feature: GZ8MTXP02FQABB.11.86.H09.1.454.CMB.2.raw
  modified_base (484)..(484): a, c, t, g, unknown or other
  modified_base (487)..(487): a, c, t, g, unknown or other
  modified_base (489)..(491): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaaccggcccccaaactcctcatctatagtaataatcagcggccctcaggggtccctgaccgattctctggctccaagtctggcacctcagcctccctggccatcagtggctccagtctgatgatgaggctgattatactgtgcagcatgggatgacacctgaatggtctgtgtggtttcggcggagggaccaagctgaccgtctaggtcagcccaaggctcgccccctcggtcactctccgttccccgccctcctcgtactcctctcgctgacgcgggctggcaggcncangnnn

SEQ ID NO: 377074 - DNA, 508 bp, Homo sapiens
  misc_feature: GZ8MTXP02FPA2B.11.86.H09.1.454.CMB.2.raw
  modified_base (501)..(508): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgatttattactgtgcagcagtgggatgacacctgaatggtcttgtgtggttttcgggcggtagggaccaagctgaccgtccgtaggtcacgcccaaggcctcgccccctcggtcacctcgtcgttcccgccctccctcgtactctctcgctgagcgggctggcgaacggcgcagnnnnnnnn

SEQ ID NO: 377075 - DNA, 512 bp, Homo sapiens
  misc_feature: GZ8MTXP02H2NL1.11.86.H09.1.454.CMB.2.raw
  modified_base (472)..(472): a, c, t, g, unknown or other
  modified_base (496)..(496): a, c, t, g, unknown or other
  modified_base (503)..(512): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaaccggccccccaaatcctcatctatagtaataatcagcggccctcaggggtccctgaccgattctctggctccaagtctggcacctcagcctccctggccatcagtggctccagtctgatgatgaggctgattatactgtgcagcagtgggatcgacaccctgaatggtccttgtgttggtttcggcggtagggacagctgaccgtctaggtccagcccgaaggctcgcccccgtcggtccacgtccttacgttccccaccctcctcgtacttcnctcgctgacgcggctggcaaggcncgatagnnnnnnnnnn

SEQ ID NO: 377076 - DNA, 593 bp, Homo sapiens
  misc_feature: GZ8MTXP02JPKS5.11.86.H09.1.454.CMB.2.raw
tcagcgagagataccacgaccggtgctcgatttagtgctatagacttgggtttggggttgaaattgctgttcccagtgtaatcgatatacccaatccactccagaccctgtccctcacctgcactgtctctggtgcctccatcagtagttattactggagctggatccggcacgcccccgagggaagggactggagtggattgggtatatcgattacactgggaacagcaatttccaaccccgcctcaagagtcgagtcaccatatcagtagacacgtcaagaaccacttctccctgacgctgacctctgtcgaccgctgtggacacggccgtctattactgtacgagatccaaatgattacgatcgactcggttccgaccccgtgggggcccaggggaacccctgggtccaccgtctcctcacgccctccaccacgggccacgtccggtcccttccccgtcgcccaccctcctaccaacgacgccaccgtcgtcgggggccacgacgccggccccgtgggccgtcgcccgtcggtaccgaaacggtacctaccttccgtactcctcgtccgcgtacgcggccgggtcgtcgg

SEQ ID NO: 377077 - DNA, 614 bp, Homo sapiens
  misc_feature: GZ8MTXP02JEUFC.11.86.H09.1.454.CMB.2.raw
  modified_base (316)..(316): a, c, t, g, unknown or other
tcagcgagagataccacgaccggtgctcgatttagtgctatagacttgggtttggggttgaaattgctgttcccagtgtaatcgatatacccaatccactccagaccctgtccctcacctgcactgtctctggtgcctccatcagtagttattactggagctggatccggcagcccccagggaaggactggagtggattgggtatatcgattacactgggaacagcaatttccaaccccgcctcaagagtcgagtcaccatatcagtagacacgtcaagaaccacttctccctgacggctcgacctctgtgaccgntgtcgacacggccgtctattactgtacgagataccaaatgattacatcgactgggttccacccgtgggggacccaaggggtaaccctgggtacccgtaccgtcctccctcacgtccctacccgaccgaccgggccctacgtccgtccttcccccgtcggccctaccccgtccctaccgaacgtacgaccaccgtcggtcgggggccaacgcggccggcccgtcgggcctcggccgtacggtacgaacggtactaccgttcgtactcctcgtccgtcgtcggacggtcggtcgaccggg

SEQ ID NO: 377078 - DNA, 509 bp, Homo sapiens
  misc_feature: GZ8MTXP02FL6UC.11.86.H09.1.454.CMB.2.raw
  modified_base (265)..(265): a, c, t, g, unknown or other
  modified_base (501)..(509): a, c, t, g, unknown or other
tcagcgagagataccacgaccggtgctcgatttagtgctatagacttgggtttgggggccgttcctgggcccagtctgtgctgactcagccaccctcagcgtctgggaccccccgggcagagggtcatcatctcttgttctggaagcagctctaatatcggaagtaatactgtaaattggtatcaacaactcccaggaaccggcccccaaactcctcatctatagtaataatcagcggccctcgaggggtcccctgaccgattcnctggctccaagtctggcacctcagcctccctggccatcagtgggctccagtctgatgatgaggctgatttattactgtgcagcatgggatgaccaccctgaatgtccttgtgttggtttcggcggaggaccaagctgaccgtcctaggtcagcccaagctcgccccctcggtcactcctcgttccccaccctccctcgtactctctcgctgacgccgggctggcaaggcgcatagnnnnnnnnn

SEQ ID NO: 377079 - DNA, 500 bp, Homo sapiens
  misc_feature: GZ8MTXP02GCW2B.11.86.H09.1.454.CMB.2.raw
  modified_base (403)..(403): a, c, t, g, unknown or other
  modified_base (492)..(500): a, c, t, g, unknown or other
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaatcctcatctatagtaataatcagcggccctcagggggtcccctgaccgattctctggctccaagtctggcacctcagcctccctggccatcagtggctccagtctgatgatgaggctgattatactgtgcagcatgggatgacacctgactggtccttgtgtggtttcggcggaggacagctgacgtcgtagcncgaccaggctcgccccgtcgctactctctcccaccctcctcgtatcctctcgccgtgacggtcggcgtggacgaacggcgtacagtgannnnnnnnn

SEQ ID NO: 377080 - DNA, 690 bp, Homo sapiens
  misc_feature: GZ8MTXP02JPKWA.11.86.H09.1.454.CMB.2.raw
  modified_base (118)..(118): a, c, t, g, unknown or other
  modified_base (213)..(213): a, c, t, g, unknown or other
  modified_base (653)..(653): a, c, t, g, unknown or other
  modified_base (678)..(679): a, c, t, g, unknown or other
  modified_base (681)..(681): a, c, t, g, unknown or other
  modified_base (683)..(683): a, c, t, g, unknown or other
  modified_base (685)..(687): a, c, t, g, unknown or other
  modified_base (689)..(690): a, c, t, g, unknown or other
tcagcgagagataccacgaccggtgctcgattttagtgctatagacttgggtttgggggccgttcctgggcccagtctgtgctgactcagccaccctcagcgtctgggacccccgggnagagggtcatcatctcttgttctggaagcagctctaatatcggaagtaatactgtaaattggtatcaacactcccaggaaccgccccaaatcctnatctatagtaataatcagccgcctcgaggggtccctgaccgtattctcgtcggctaccgaagtccgtggcaccctcacgccctcccgtggccagtcgaggtcgggctccgagtctgatcgagtgacggtcttaggtatttacttacgtgtcgcaacgctaggtcggattcgaacctacccgtagtaacgttcgggttcctttaggttggttttacgggggttttccgggacgggggtaacgggtaacccgtaaaggtccgttacgggtacccgtttacggtaacgggttccaccggttaccccgaaacgggtcccgttccccggtaccccccgtttgggtaacccttccgtttcccgttaccccggggtttcccccttaaccccgttcccgtttacggttaccttccgtccgtccggtcgtcgggcggtccggggttacncgggtaccgaagcccggatagtcgnngncncnnncnn

SEQ ID NO: 377081 - DNA, 536 bp, Homo sapiens
  misc_feature: GZ8MTXP01ESH5B.13.87.H10.1.454.CMB.2.raw
  modified_base (351)..(351): a, c, t, g, unknown or other
  modified_base (357)..(357): a, c, t, g, unknown or other
  modified_base (366)..(366): a, c, t, g, unknown or other
  modified_base (384)..(384): a, c, t, g, unknown or other
  modified_base (425)..(425): a, c, t, g, unknown or other
tcagtcacgtactacacgaccggtgctcgatttagcagtactgcgttgggtttggggagaggagcccagccctgagattcccaggtgtttccattcagtgatcagcactgaacacagaggactcaccatggagttgggactgagcgtggattttcctttggctatttaaaggtgtccagtgtgaagtgcagctggtggagtctgggggaggcttggtacagcctggcaggtccctgagactctcctgtgcagcctctggattcacctttgatgattatgccatgcactgggtccgcaagctccgagggagggcctgggagtgggtctcaggtatagttggaatagtggtancatagntatgcgctntgtgaggcgatcacatcncagagacaacgacaacaactacctactacgtctagacaaanagaacgacgacgagagagacgtgaggaacgacgttcgttgttagttattagttagacaaacgtaactaccctaacccttaacgttacgtttaggttaaggttaaggttaag

SEQ ID NO: 377082 - DNA, 615 bp, Homo sapiens
  misc_feature: GZ8MTXP01DQNRW.13.87.H10.1.454.CMB.2.raw
  modified_base (295)..(295): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagctggtatcaagcaaaaaaccagggaaatccctaaagctcctgatctaatgttncactcctatttgactaaaggtcgggtaccatacgaaggttcaggccggacaggtggatcgtaagggaacaagtaattcactctacaacaaatacacgacacgacgtcgcgacgaccgtagtaagtaagtttagtactaaacttaacttaacttacggtactaaactaacgtaacttaaacttaacgttacccgtaccgttaccgttacggttacgggtacgggaacggggaacggtaaacgggtagggaaggtaacgttaacgtaaacgtaacgttaggttcggttacgtcgacaacctactacttacgttcgttctaac

SEQ ID NO: 377083 - DNA, 527 bp, Homo sapiens
  misc_feature: GZ8MTXP01EC7R8.13.87.H10.1.454.CMB.2.raw
  modified_base (447)..(447): a, c, t, g, unknown or other
  modified_base (502)..(502): a, c, t, g, unknown or other
  modified_base (520)..(520): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagttatttagctggtatcagacaaaaaccagggaaagtccctaaagctcctgatctatgttgcatccatttgcaaagtggggtccatcaaggttcagccggcagtggatcgtagggacaagaattcaactctacacaatcagcagcctgcagtcctagaagtattttagactaaacttattactaggtacaactagtacttaatacgttaccctnttaccgagtttcggacggtagggaccaaagggtggagattacgaaacgtattggngctaagcaacctatcttntcttctc

SEQ ID NO: 377084 - DNA, 598 bp, Homo sapiens
  misc_feature: GZ8MTXP01BBJVA.13.87.H10.1.454.CMB.2.raw
  modified_base (306)..(306): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcttggtacagcctggcaggtccctgagactctcctgtgcagcctctggattcacctttgatgattatgccatgcacgtgggtcccggnaaggcctaccgagggggacgggccgtgggagtggggtctcgagggttattaggttggaaattggtggtagcaaagtagggctagtggcgggtactcgtgtaggaacgggtccgtagttccacctatcctaccgaaggacgaacaacggaccaaagaacctccctagtactctgactaaatacgaacagacctagacgtagctagggacggaacacggttcttagttagttagtggttacgacaaacgtaactacccgtaaccctttacgtagttttcggaagttggttaacg

SEQ ID NO: 377085 - DNA, 659 bp, Homo sapiens
  misc_feature: GZ8MTXP01CD2CN.13.87.H10.1.454.CMB.2.raw
  modified_base (264)..(264): a, c, t, g, unknown or other
  modified_base (297)..(297): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagttatttagtctggtatcagacaaaaaaccngggaaacgtccctaaagctcctgatctatgttncatccctatttgactaaaaggtcggggtacccattacgaaaggttcaaggcccggcaggtggatcgtaggggaacaagaaatttcaactctacaacaatcagcaaggccctcgacacgaccgtacgtaagtagtttacgtactaaacttaatttaacgttacgttactaaacgtaacgtaacttaacttaaacgttaacccggtaccttaccgtacggtttaccgggttaccggggtaacggggaacccggtaaacgggttaacgggttaagggaaagttaacgtaaaacgtaaaccgttaggttacggttacgttaacggtaccgaaccgtaactacgttacgttccgttcgtttaacccg

SEQ ID NO: 377086 - DNA, 520 bp, Homo sapiens
  misc_feature: GZ8MTXP01BTACS.13.87.H10.1.454.CMB.2.raw
  modified_base (350)..(350): a, c, t, g, unknown or other
  modified_base (391)..(391): a, c, t, g, unknown or other
  modified_base (439)..(439): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaccagggaaatcccaaagctcctgatctatgttgcatccatttgacaaagtgggtccatcaaggttcagccggcagtggatcgtagggacngaattcactctacacaatcagcagcctgcagcctagaagtntttgactaacttattactggtacaatagtacttaaatcgttaacccgnttacgagtttcgggcggtaagggaccaagggtggaagacttacgaaacgtacttgcggctgcaacatcttagtctttcaac

SEQ ID NO: 377087 - DNA, 555 bp, Homo sapiens
  misc_feature: GZ8MTXP01EZ3QM.13.87.H10.1.454.CMB.2.raw
  modified_base (358)..(358): a, c, t, g, unknown or other
  modified_base (401)..(401): a, c, t, g, unknown or other
  modified_base (459)..(459): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagtttatttagtctggtatcaagacaaaaaacgagggaaagtccctaaagctcctgatctatgttgcatcctatttgacaaaggtggggtcccatcaaggttcagccgcagtggatcgtagggacngaattcactctacacaatcagcagcctgcagcctagtaaagtnttttagactaaactttattactgggtacaaactagtacttaaagtacgttaccccgtnttacgtaggtttcggcgggtaagggacctaagggttggagaattacgaaaacggtaacttggttggctgctaacctatccttgtcctttcgtaacc

SEQ ID NO: 377088 - DNA, 603 bp, Homo sapiens
  misc_feature: GZ8MTXP01A53O4.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggactattaacagtttattagtctggtatcagacaaaaaccgagggaaagtccctaagctcctgatctatgttgcatcctactttgactaaaggtcgggtaccatcaaggttcagccggcaggtggatcgtagggaactaagtattcactctacaacaatcagcacgcctgcagcctagaagtatttgactaattattactaggttacaaatagtactttaaacgtacgttacccgcttacgtagggtttccgggacggtaacgggaaccgtaaagggtcgggaaagtacttaaacgtaaaaccggtacgttagggttcggaccgttaaggaccctaaccggttaacttcccggtttcgtttaaccctttccgttaacccg

SEQ ID NO: 377089 - DNA, 575 bp, Homo sapiens
  misc_feature: GZ8MTXP01DVJKH.13.87.H10.1.454.CMB.2.raw
  modified_base (490)..(490): a, c, t, g, unknown or other
  modified_base (502)..(502): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagcgtggtggagtcgtggggggagcttggtacagcctggcaggtccctgagactctcctgtgcagcctctgattcacctttgatgattatgccatgcacgtcggggtcccgacaacgcgtcccgaagggggaacgggccgtagggaggtcggggtctccgagggttattaggtggaaatagtggtgcagtaggctagtgcgggactcgtgtaggacgggcctattccgaccgtctaccgagggaccaactacaaagaactaccgttatactctagcagatacgaaacncgtcctagaggnggtgaacgcgtacggctagtaacttacgttcgttagtcggactaacaaaactgttagtaagtttggtttaagg

SEQ ID NO: 377090 - DNA, 616 bp, Homo sapiens
  misc_feature: GZ8MTXP01D0TJ6.13.87.H10.1.454.CMB.2.raw
  modified_base (186)..(186): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggngtccagtgtgaagtgcagctggtggagtcgtgggggagcttggacagcctggcaggtccctgagactctcctgtgcagcctctggattcacctttgattgattatcgccatcgctacgtggggtcccggcaacggcctaccgaggggacgggccgtgggacggtgggtctccgaggttagttaggtggaagtaaggtggtaagctaagttagggctagtggacgtactcgtggtaggaacgggccgtattaccgaacctacttcctaccgaacgacgaaccaaaccgacccaaacgggtaaaccctcccgttagtaactcgtacgaacaaagtacgaacagcctaggagaacgcgttaggacggacgaacggtctttagttattagttgtacgaacaaaacgtacttaccctaacccgtttaagtttaag

SEQ ID NO: 377091 - DNA, 592 bp, Homo sapiens
  misc_feature: GZ8MTXP01CJB5D.13.87.H10.1.454.CMB.2.raw
  modified_base (386)..(386): a, c, t, g, unknown or other
  modified_base (389)..(389): a, c, t, g, unknown or other
  modified_base (396)..(396): a, c, t, g, unknown or other
tcagtcacgtactacacgaccggtgctcgatttagcagtactgcgttgggtttggggagtcccagtcaggacacagcatggacatgagggtccccgctcagctccgtggggctcctgctgctctggctcccaggtgccagatgtgacatccagttgacccagtctccatccttctgtctgcatctgtaggagacagagtcaccatcacttgccggcagtcaaggacattaacagttatttagctggtatcagacaaaaaccagggaaagtccctaaagctacctgatctaatgttgcatccaactttgactaaaaggtcggggtcccagtcaaaggttcaagccggcagtggatcgtagggacaagaattcacttcacaacgtaancanacacgcncgacgacgacgtagtagtattagtactaacttaattactacgtactaactacgtaacttaacttaacgttaccgtacgttacgtacgttacgggtacgggtaacgggaacggtaacggtaaggaagtaacgaacgtaaacgtaacgttacgttcggttacgtaacgacgaacgtactcttacttccgttcgtaacg

SEQ ID NO: 377092 - DNA, 545 bp, Homo sapiens
  misc_feature: GZ8MTXP01DAKWN.13.87.H10.1.454.CMB.2.raw
  modified_base (294)..(294): a, c, t, g, unknown or other
  modified_base (394)..(394): a, c, t, g, unknown or other
  modified_base (440)..(440): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagacaaaaaccagggaaatccctaaagctcctgatctatgttncatccatttgacaaaggtgggccatcaaggttcagccggcagtggatcgtagggacaagaattcactctacaacatcagcagcctgcaagcctagaagtntttgactaactttatactgtacaacagtcttaaatacgttacccgnttcgtaagtttcggggacggtaacgggaaccaaaggggttcggaagtacttacgaaaacgtacgttggttggctaagacaacctattccttgttccttcgtaacc

SEQ ID NO: 377093 - DNA, 607 bp, Homo sapiens
  misc_feature: GZ8MTXP01BFJYK.13.87.H10.1.454.CMB.2.raw
  modified_base (476)..(476): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttctgtctgcatctgtaggagacagatcaccatcacttgccggcagtcaggactattaacagtttattagtctggtatcagaacaaaacagggaaactccaagctctgatctatgttgcacttccatttgactaaaggtcggggtaccatcgaaggttcaggccggcaggtggactcgtaagggaactaagacttcactactcaacaatccaagcaacggcctgaccagtaccgtagaagttactttagaaccttaaactttattacctgggtaacaacgtagtactttaaagtacgttaccccgnttaccgtaggtttaccgggacgggtaacgggaaccgtaaagggttcgggaaagtaaacgttaaccgaaaaaaccgggtattcgggttcggttacctaaggacctaactacgtcttatcctttaacgtaacc

SEQ ID NO: 377094 - DNA, 558 bp, Homo sapiens
  misc_feature: GZ8MTXP01ATNMI.13.87.H10.1.454.CMB.2.raw
  modified_base (363)..(363): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagttattagtctggtatcagacaaaaaccagggaaatccctaagctcctgatctatgttgcatccatttgactaaagtgggtccatcaaggttcagccggcagtggatcgtagggacaagaattcactctnacaatcagcagcctgcagcctagaagtattttgactaaactttattaaccgtaggttacaaactagtactttaaagtacgttaacccgcttacgtaacgtttcggggacggaaggggtacccgaaaggggtcggaagaacttaccgaaaacggacgttggacggctcggcaacctagtcttgttaacttcgtaac

SEQ ID NO: 377095 - DNA, 579 bp, Homo sapiens
  misc_feature: GZ8MTXP01EVLYZ.13.87.H10.1.454.CMB.2.raw
  modified_base (367)..(367): a, c, t, g, unknown or other
  modified_base (380)..(380): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtccgcaagctccgaggggacggcctggagtgggtctcgaggtatagatggaaatagtggtancagtagggctagngcggactcgtggtggaagggccgattccgacctatctacccgagaacgaaccaacgaccgaaagaaccctccgtagtatcagacaaatgaaaccagcctggaagcgcgtggaacggcgtaaccgggttcctttggttaactttaagttggtaacgaacgtaaaacggttacttaacccccttaaaccccgttttaaggg

SEQ ID NO: 377096 - DNA, 576 bp, Homo sapiens
  misc_feature: GZ8MTXP01CEAN9.13.87.H10.1.454.CMB.2.raw
  modified_base (306)..(306): a, c, t, g, unknown or other
  modified_base (359)..(359): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctatttaaaggtgtccagtgtgaagtgcagctggtggagtcgtgggggagcttggtacagcctggcaggtccctgagactctcctgtgcagcctctggattcactttgatgattatgccatgcacgtggggtccgnaacgctccgagggacggcctggagtggtctcgaggtatagtgataaggtggtncagtagggctagtggcggactcgtgtggaagggccgagttcaccatctccagacgaacaacgaccaaacggaactcccgtagtactctacgacaaagtacgaacagacctaggaaggaacgcgttggaacggaccgtaaccggtccgtttagttagtttacgtttggtacgaacgaaaaacggtacttacccctaaaccccgtttaacgttttaagg

SEQ ID NO: 377097 - DNA, 580 bp, Homo sapiens
  misc_feature: GZ8MTXP01EC9JH.13.87.H10.1.454.CMB.2.raw
  modified_base (261)..(261): a, c, t, g, unknown or other
  modified_base (309)..(309): a, c, t, g, unknown or other
  modified_base (472)..(472): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagagtactcaccatggagttgggactgagctggtatttttcctttggcttatttaaaaggtgtccagtgtgaagtgcagctggtggagtcgtgggggagcttggtacagcctggcaggtccctgagactctcctgngcagcctctgattcactttgatgattatgccatgcacgtgggtccganagcctccgaggggacggctggagtgggtctcgaggttattaggtgaatagtggtaagctagtagggctagtggcggtactcgtgtaggaacgggcctattccaaccgatcctaccgaagacgaaaccaaacgacccaaaggtaaccctccctagtactcgtanaccaaatacgaactagcctagagaacgcttaggacgaccgtacggtctttagttatttagttgtacgaaacaaaagtaccttaccccgtaaaccccgtttgtttaagg

SEQ ID NO: 377098 - DNA, 522 bp, Homo sapiens
  misc_feature: GZ8MTXP01B0HMO.13.87.H10.1.454.CMB.2.raw
  modified_base (380)..(380): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagtttatttagtctggtatcagcagaagccagggagagtccctaaattattgatctctgctgcgtccgcttgcaagtcgggggtccatctcggttccagtggcgtggatctagcagaattcactctcacatcacaactgcacctgaagntgtagaagttatactagtcaggactagtagtggtcgccgctctagtttcggcggaggaccgaaggtgacaggacttacgaaaacgtaacgttgttcgggcttggacccaacccgtaatcccttggtttccgttcgttaaccg

SEQ ID NO: 377099 - DNA, 653 bp, Homo sapiens
  misc_feature: GZ8MTXP01A7I42.13.87.H10.1.454.CMB.2.raw
  modified_base (270)..(270): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcttggtacagcctggcaggtccctgagactctcctgtgcagcctntgattcactttgatgattatgccatgcacgtgggtccgacaagcctaccgagggggaacggccgtggaggtgggtctacgaggttattaggttggaatagggtggtgctaagtagggctagtcgcgggtacttcgtaggtaggaacggggccctattacccgaaccctattcccgacccgaaggaacgaaacccgaaaccggaccccaaaggggtaaaccccttcccgttagttaacttcgtaacgaacctaaaagttacgaaaccgacggtaccctaggaaggtaacgcgttagggaacggaccgtaacgggtcctttaggttatttacgttgtacggaacctaaaaacgtccttaacccctaaaccccgtttgttttaagg

SEQ ID NO: 377100 - DNA, 754 bp, Homo sapiens
  misc_feature: GZ8MTXP01DOUQF.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttccttttggcttaattttaaaaggtgtccagtgtgaagtgcagcgtgggtggagtcgtggggggagtcttggtacagcctggcaggtccctgagactctcctgtgcagcctctggattcactttgatgattatgccatgcacgtcgggtccgacaacggccgtacccggaagggggaacgggtcccgtaggggtaggttcggggtccttacggtaagggtttaatttagggtttaggaaagttaaggttacgggttaaggactaaagttacgggcttaagtcgggaccgggtaacttcgttagggtacgggaaacggggtccctaaacgtttacccgaaacccttattcccgtaacccgaaaggaaacggaaaccccaaaaccggtaaccccgaaaacggggtaaaccccttccccgttaagttaacgtcccttaacggaaacccttaaaagtacggaaaaccacggtacccgttaggaaacgaacgtccgttagggaaacggaccgtaaaccgggttcctttaggttattaacgttggtaacaaacgtaaaacgtacttaccccctaaaccccgttttaaggtttaagg

SEQ ID NO: 377101 - DNA, 529 bp, Homo sapiens
  misc_feature: GZ8MTXP01E22GW.13.87.H10.1.454.CMB.2.raw
  modified_base (444)..(444): a, c, t, g, unknown or other
  modified_base (496)..(496): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagacaaaaaccagggaaagtccctaaagctcctgatctatgttgcatccatttgacaaagtgggtcccatcaaggttcagccggcagtgatcgtagggacaagaatcactctcaacaatcagcagcctgccagcctagaacgtatttgactaaacttatactggtacaaacagtacttaaatacgttacccgnttccgagtttcggacggaggtaccaaagggtgaagattacgaaaacgtaacnggttcggctgcaaccatcttgttccttctaacc

SEQ ID NO: 377102 - DNA, 667 bp, Homo sapiens
  misc_feature: GZ8MTXP01CZXTO.13.87.H10.1.454.CMB.2.raw
  modified_base (308)..(308): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgagctctcctgtgcagcctctggattcacctttgatgattatgccatgcacgtgggtccgnaagcctaccgaggggacggcctgggagtcgggtctcgtagggttattaggttagggaaattaagggtggtaagacgtaagtagggtctaagtcggacggtacttcgtaggtaggaacggggtccgtaattccaactacgtcctaccgaagaacgaacaaaccgacccaaagggaaccctcccgtagtactactacgaaccaaagtacgaaacacggtacctaggaaggaacgtcgttagggaaacgggaaccgtaccgggtacccgttttaggttaacgttttacgttaaggtaacggaaaccctaaaaaacggtacccttaaacccccttaaacccccgtttaaacggttttaacggg

SEQ ID NO: 377103 - DNA, 688 bp, Homo sapiens
  misc_feature: GZ8MTXP01CTAAH.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccctgagctctcctgtgcagcctctggattcactttgatgattatgccatcgcacgtggggtcccgacaaggccgtccgaagggggacgggcctgggaggttcgggtctccgtaggttattaggttaggaataaggttggtaagctaagtaagggctaagtggcggtactcgttggacggtaacggggccgtacgttaccgacccggttcctaccgaacggggaaccaaaccgttaccaaaacggtaaacccttaacccgttttaataaacttaccgttacgaaccgtaaagaagttacgaaaaacccgtcggtaccgtagggaacgggtaacgggtaacggtaaccggttaccgttcggttacgtttaacgttaactttaccgtttcgttaggtaacgaaccgtaaacgtaaacgtagttaggttaagtttgggtttaagg

SEQ ID NO: 377104 - DNA, 571 bp, Homo sapiens
  misc_feature: GZ8MTXP01EKBSE.13.87.H10.1.454.CMB.2.raw
  modified_base (311)..(311): a, c, t, g, unknown or other
  modified_base (477)..(477): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgnagctcgagggacggctggagtgggtctcgaggttataggttggaattaggtggtaagctaagtagggctagtggacggtatcgtgtaggaacgggcctattcacctatcaccagacaacaacgaccaaaggtaacctccctagtactcgtagaacaagtacgaacncgtcgtagagcgtcgacggacgacgtacggtactttagttattagttgtaacgtaacgtaaacgtccttaacccgttaacccgtttaagttaag

SEQ ID NO: 377105 - DNA, 643 bp, Homo sapiens
  misc_feature: GZ8MTXP01DOQNK.13.87.H10.1.454.CMB.2.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtcgggtccgcaagcctccgaggggacgggcctgggagtgggtctcgtaggtattaggtaggaattaggtggtagctaagtaggctagtcggcgggtactccggtagggacggggccgtattcgacctatctaccagacgaactaacttaccaaagaaccacgtacttacgttttacttaacgtaaattacgaaactacgacccgtggaaggtaacgcccgtaagtcggaaccgaccgggtccgttgttaactttacgttggttcggacggttaaggaggttacgggtccgggggacccctaacgggtaaaccggttacgttaccggtaacgttaacggttaaccgggg

SEQ ID NO: 377106 - DNA, 706 bp, Homo sapiens
  misc_feature: GZ8MTXP01BN3QI.13.87.H10.1.454.CMB.2.raw
  modified_base (288)..(288): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagttattagtctggtatcaagacaaaacgagggaactcctaagctctgatctatgtncactcctatttgactaaagggttcggggtaccctagtacgtaaggttcgacggccggacgtaggtcggtagtccggtaaagggggaacctaaggtaaactttcctaccttcctacaactaaatccaagccaacggtccctggacctacgtacccgttaaggtaaagtttacgttttacgaaccttaaacgttttaagttaaccttacggggttaaactaaaaccgttacggttaaacctttttaaaacgttacccggtttaaccccggtactttaccgggttaacggggttttacccgggggaacggggtaaacggggtaacccgtaaagggggttaggaaagtaaacgttaccgaaaacggtacgttgggttcgacgtaacgcctaaacctgttccgttacgttcctttcgtaaccc

SEQ ID NO: 377107 - DNA, 623 bp, Homo sapiens
  misc_feature: GZ8MTXP01C0MNF.13.87.H10.1.454.CMB.2.raw
  modified_base (261)..(261): a, c, t, g, unknown or other
  modified_base (265)..(265): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtatttttcctttggcttaattttaaaaggtgtccagtgtagaagtgcagcgtggtggagtcggtgggggagtcttggtacagccgtggcaggtccctgagctctctgtncacnctctggtacttctactttgatgtattatcgccatcgctacgttgggcccgacaaacggcctaccggaagggggacggtccgtgggtagtcggggtctagtaggttattaggttaggaataggtcgtagctaaagtgctagtggacggtactcgtagggtaggaacgggccgtattccaactatcctacaagacgaacaaccgaccaaacgtacctacctagtactctagaacaaactacgaacgacgtcgaagagtacgacgtagacggtaactcgggttactttagttattagtagttaattaacgaaataaccttaccctaaccctttagtagtttaggtaacgttcggttaacgg

SEQ ID NO: 377108 - DNA, 617 bp, Homo sapiens
  misc_feature: GZ8MTXP01EMUW3.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtcgggtccggacaagcctaccgaaggggaacggccgtgggagtggggtctcgagggttattaggttgaagttaggtggtaagctaagtagggctagtcggcggtactcgtggtaggaacgggccgtattaccaacctattacccgacccaaggaacgaaccgaaaccggacccaaaacgggtaacccttcccgtagtactccgtaagacctaaagtacgaacacgtccgtagagaacgcgttaggacgacgtacggtacttagttattagtaagtacgaaactaaacgtaccttaacccttaaccgtttaagttaag

SEQ ID NO: 377109 - DNA, 549 bp, Homo sapiens
  misc_feature: GZ8MTXP01AQMWG.13.87.H10.1.454.CMB.2.raw
  modified_base (456)..(456): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagttatttagtctggtatcagacaaaacgagggaagtcctaagctcctgatctatgttgcatcctatttgacgtaaagtcggggtcccagtacgaaggttcaggccgcaggtggatcgtaagggacaagtaattcactctacacatcagcagcctagcagtacctagtaagtattttacgactaatttattactggtacaagtagtacttaaatacgttacccgntacgtaggttccggaggtacggacgtaagggtggaagtacttacgaaacgtacgttggttggctgactaacctatcgttacgttcttcgtaac

SEQ ID NO: 377110 - DNA, 659 bp, Homo sapiens
  misc_feature: GZ8MTXP01EDQQQ.13.87.H10.1.454.CMB.2.raw
  modified_base (192)..(192): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagatgacccagtctccatcctccctgtctgcatctcttgganacagagtcaccgtcacttgccgggcgagtcacgactaattaacactttattagcctggtatcagcagaagccgagggagagtacctaaattatgatctctgctgcgtccgtccttgcaagtccgggggtcccagtcgtcggttccgaggtggcggtggatacgtaggaacagtaattcactctacacactaccacctaacctcgacctacccgtagaaagtagttaggttaggtaaagtttacttaacgtgttacgaacggtaacccgttagttacgggttacgggtccggtccccgtccgttaccgttaacggtttttccggggacggggtaacggggtaacccgtaaaggggttcggaccgttaaaggtaaacgttaaccgtaaaaaccgtaaaccgttgggttacgggccttaacgggaccctaaccgtcttaccttacggtttcctttaaccgtttaaccccg

SEQ ID NO: 377111 - DNA, 559 bp, Homo sapiens
  misc_feature: GZ8MTXP01DH2AT.13.87.H10.1.454.CMB.2.raw
  modified_base (426)..(426): a, c, t, g, unknown or other
  modified_base (469)..(469): a, c, t, g, unknown or other
  modified_base (527)..(527): a, c, t, g, unknown or other
  modified_base (536)..(536): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggactattaacagtttattagtctggtatcaagacaaaaaccgagggaactccctaaagctcctgatctatgttgcatcctatttgacgtaaaggtcggggtacccagttcgaaaggttcaacggtccggcaaggtggtaactcgtaaggggaacaaggtaactttccaacttctacactaatcagcagcctgcagactggaatntttgactaattatactggtacaactagtcttaatacgttcccngttactaggttcggacggtagggaccgaaggtggagtacttacgaaaacgtcgttggnggctgaccncgtatcgttacttcttctaaccg

SEQ ID NO: 377112 - DNA, 635 bp, Homo sapiens
  misc_feature: GZ8MTXP01CCP0P.13.87.H10.1.454.CMB.2.raw
  modified_base (233)..(233): a, c, t, g, unknown or other
  modified_base (311)..(311): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggaggcttggtacngcctggcaggtccctgagctctcctgtgcagcctctggattcacctttgatgtattatcgcatgcacgtcgggtccgnaagctacgaggggacggcgtggagtggtctaccgtaggtattaggtaggaataagtggtaagctaagtaggtctagtcgggcggtactcgtaggtacgggaacgggccgtagttaccacctaagtccgtaccgaagacgaaaccaaccggacccaaacgggtaacccttccgtagtaactcgtacgaactaaacgtcgaaacacgaccgtaggacgtaacggtcgttgggaacgacggtaccggtctttaggttacctttagttaaggtaccaaacgtaaaacgtacccgttaaccccgttaaccccgtttaagttttaacggg

SEQ ID NO: 377113 - DNA, 529 bp, Homo sapiens
  misc_feature: GZ8MTXP01B8V2J.13.87.H10.1.454.CMB.2.raw
  modified_base (405)..(405): a, c, t, g, unknown or other
  modified_base (447)..(447): a, c, t, g, unknown or other
  modified_base (473)..(473): a, c, t, g, unknown or other
  modified_base (512)..(512): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggactattaacagtttattagtctggtatcagacaaaaaaccgagggaaactccctaagctcctgatctatgttgcatcctatttgactaaagtcggggtccagtcaaaggttcaaggtccggacaggtggatcgtagggaacaagtaattcactctacacaatcagcagctgcagctagaatntttgactaacttatacgtgtacaagtatacttaatacgtccntactgttcggacgaagggctaagggngagacttacgaaacgtattggttcggctgactaaccttntcgttctcgttctaacg

SEQ ID NO: 377114 - DNA, 565 bp, Homo sapiens
  misc_feature: GZ8MTXP01EMH7S.13.87.H10.1.454.CMB.2.raw
  modified_base (192)..(192): a, c, t, g, unknown or other
  modified_base (470)..(470): a, c, t, g, unknown or other
  modified_base (555)..(555): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggcagtcaggactattaacagtttatttagtctggtatcagacaaaaaccagggaaatccctaagctacctgatctatgtgcatccatttgacaaagttcggggtccatcgaaggttcagtccggcagtggatcgtagggaacaagaattcactctacaacaatcagacagcctgaccagtaccgtagtaagtacttttacgacttaaactttattacctagggtacaaactagtactttaaatacgttaccccgnttacgtacggtttcgggacggtacgggaacaaagggtggaagtacttaacgaaacgtaacttggttgactgactaaccatcgttntcttctaacc

SEQ ID NO: 377115 - DNA, 581 bp, Homo sapiens
  misc_feature: GZ8MTXP01BW4LX.13.87.H10.1.454.CMB.2.raw
  modified_base (298)..(298): a, c, t, g, unknown or other
  modified_base (322)..(322): a, c, t, g, unknown or other
  modified_base (420)..(420): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtggggggagcttggtacagcctggcaggtccctgacgactctcctgtgcagcctctggacttcacctttgatgtattancgccatcgctacgtcgggtccganacgcgtaccgaggggacggcgtggagtcggtctcgaggtattagtaggaataaggtgtgcagtaggctagcgcgactgtgaggaacgggctatcactntcacagacacaacgaccaaggtaacctcctagtactactagaaccaaatacggaaacacggtcctagaggaacgcgttagggaaacgaccgtaacgggtctttagttaattagttcgtagaacctaaaagtccttaacccgtaacccgtttaagtttaagg

SEQ ID NO: 377116 - DNA, 590 bp, Homo sapiens
  misc_feature: GZ8MTXP01CKXGI.13.87.H10.1.454.CMB.2.raw
  modified_base (259)..(259): a, c, t, g, unknown or other
  modified_base (266)..(266): a, c, t, g, unknown or other
  modified_base (310)..(310): a, c, t, g, unknown or other
  modified_base (502)..(502): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctgggtggagtcgtggggggagtcttggtacagcctggcaggtccctgagactctcctgtncagcctntggtattccactttgatgtattatgccatgctacgtgggtccgnaagcgtaccgaagggacgggtcctagggagtgggtctagaggttattaggtacggaataggtgtagctaaagtggctagtgacgggactgtggtagaacgggcctataccactatcctaccgaagaacgaaccaaaccgaccaaagaacctaccgtgtactcgtagaacaaatacgaaacacgcgtaagagnacgtagacggaacgtacggttcttagttattatgttaagacaaagtaacctaccctaaaccgttgttacgtttgaacggttgttaacg

SEQ ID NO: 377117 - DNA, 620 bp, Homo sapiens
  misc_feature: GZ8MTXP01EPR8Z.13.87.H10.1.454.CMB.2.raw
  modified_base (494)..(494): a, c, t, g, unknown or other
  modified_base (604)..(604): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatccacttcgccgggccagtcaggactattaacagtttattagtctggtatcaagacaaaacgaggaaacgtcctaaagctctgatctatgttgcactcctatttgacgtaaacggttcgggggtaccctagttacgtaaggttcacggccggacgtagggtaggatacgtagggaactaagtacttcactctacaacatcagcacggcctgcagtcctaggtaactatttgactaatttaacttacgtaggtaacctaaagtacgttacttaaacttccgttaccccggnttaccggtggtttaccggggacgggtaacgggaacggtaaaggggtgaaacgtacgttaaacgaaacggtaacgttggttcgggttaccaaggacctaacgtatccgttntccttaacgttaaccc

SEQ ID NO: 377118 - DNA, 628 bp, Homo sapiens
  misc_feature: GZ8MTXP01ERU5U.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagccgtggcaggtccctgagactctcctgtgcagcctctggattcactttgatgtattatgccatgcacgtcggggtccgacaacgccgtacccggaagggggacgggccgttgggagttgggtctacgaggttattaggttggaaagttagggtggtaagctagtacggctagtggcgggtacttcgtggtaggaacgggccgtattccaaccgtatcctaccgagaacgaccaaaccgacccaaacgggtaacccttcccgtagtactacgtagaacgaaatacggaaacacgtccgtagaagaacgcgttagggaacggttaccgacggtcctttaggttatttagttgtagaactaaaacgtccgttaaccctaaccccgtttaagtttaagg

SEQ ID NO: 377119 - DNA, 674 bp, Homo sapiens
  misc_feature: GZ8MTXP01E2F48.13.87.H10.1.454.CMB.2.raw
  modified_base (266)..(266): a, c, t, g, unknown or other
  modified_base (286)..(286): a, c, t, g, unknown or other
  modified_base (411)..(411): a, c, t, g, unknown or other
  modified_base (502)..(502): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggcttgggtacagcctggcaggtccctgagactctcctgtgcagcctntggattcacttgatgattancgccatcgcacgtcgggaccgacaacggccgtaccggaagggggtaacgggccgtagggtaggtcgggtactacgtaaggttagttaggtaggaagtaggtaggtagactaaagtacggcttagnggacggtactgtaggtaggaacgggctaatccacgtatccgacgaagacgaaccaacgaccaacgtacctcctagtactcagaacctaaanacgaacacgactagacgtacggctaacgggacggtaaccgtaccgggttactttaggtttaattaacggttagaaacgttaaaccgttaaaaccgttccctaaacccccgtttaaaccccgtttaggtttaagggttttacgggtaaacggtttaacgggtttaaacccggg

SEQ ID NO: 377120 - DNA, 928 bp, Homo sapiens
  misc_feature: GZ8MTXP01AJOU2.13.87.H10.1.454.CMB.2.raw
  modified_base (263)..(263): a, c, t, g, unknown or other
  modified_base (283)..(283): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcttggtacagcctggcaggtccctgagctctcctgtgcagcctntggattcacttgatgattangccatgcacgtcgggtccgacaaggcctaccggaagggggaacgggtccgtaggggtacggttcggggtcttacgtaagggttagtttagggttacgggaaagttagggttaggggtaacgcgtaaaaggttacgggtccgttaaggttacggggaccgggttaaaccgttcggttagggggtaaacgggggtaaacccgggggtaccccgttaacgtttacccgaaaccccttaacgttacccccgttaacccgaaaacggggtaaaccggaaaaccccgtaaaacccgggtaacccccgaaaaaacgggttaaaccccctttacccccggtttaagggtttaaccgtttacccgttaacgggaaacccctaaaaaaggtttaaccgggaaaacccttacgggaccccgttaaaggggtaacggtaacgggttaccggtaacggggaaaccggggtaacccgtaacccgggggttacccgttttaagggtttaaaccttttaaacgggttaaggttaaccgttaaaccggttaaaaaaccgggttaaccctttaaaccccccggttaaaacccccggttttttaacgggttaacggtttttttagggggtaaacggttttaacggggtttttaaaacccggggg

SEQ ID NO: 377121 - DNA, 734 bp, Homo sapiens
  misc_feature: GZ8MTXP01EKO0Z.13.87.H10.1.454.CMB.2.raw
  modified_base (299)..(299): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggaggtcgtggggggagtcttggtacagcctggcaggtccctgacgactctcctgtgcacgcctctggattctacctttgatgtattangccatgcctacgtcggggtcccgactaacgccgtacccggaagggggaacgggtccgtgggacggttcggggtccttaccggtagggttaagtttagggttagggtaaagttaagggttagggtaacgtacgtaaggttacgggtcgtaagttcggggcgggttacgttcgtggttaggaacggggtaccgtacttacccaacccgtacttaccgtaccgaacggaaccgaaaccgaaacccggaccctaaaaccggggtaaccccttaccccgttaaggttaacttaccgtacggaacctaaaacgtaacgaaaccgtacgtacccgtaggaacgaaggcgttagggaacggttaccgtacggtcccgtttagttacttagttgtacgaaacgtaaacgtaccttaccccgttaaccccgtttaagttttaagg

SEQ ID NO: 377122 - DNA, 732 bp, Homo sapiens
  misc_feature: GZ8MTXP01EHE2B.13.87.H10.1.454.CMB.2.raw
  modified_base (261)..(261): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcttggtacagcctggcaggtccctgagactctcctgngcacgcctctggattcgacctttgatgtattatcgaccagtcgacctacggttcggggtacccgacgaacgtcccgtacccgggaagggggaacgggtccgtagggggtacggtcggggttacctacggtaaggtttagtttaagggttaggaacgtttaaagggtcgggttaagactaaagtacgggtcttaaggtcgggacgggtacttcggttaggtaggaaacggggcctaacttaccaccgtacttccgaccgaagaacgaaaccgtaaaccgacccgaaacggtaacccttccccgttagttaaccttacgtaacgaactaaagtacggaaactacggaccgtaggaagtaaccggtcgacggaacggttaccgtaccggtttacgtttagtttagtttacgttaagtaaacgtaaaccgtaaaaccgtacccttaaccccgtttaacccgttttaaggtttaag

SEQ ID NO: 377123 - DNA, 765 bp, Homo sapiens
  misc_feature: GZ8MTXP01BTFU5.13.87.H10.1.454.CMB.2.raw
  modified_base (232)..(232): a, c, t, g, unknown or other
  modified_base (700)..(700): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacngttattagctggtatcgaagacaaaacgagggaaactccctaagctcctagattctatgttcgctactcctactttgacgtaaagggtcgggtacccaagttacgtaaaggttcgacggtccggacgtagggtacggtaactcggtaaacgggggaacctaagggtaaacttttacccgaaaccttaccgttaaccgaaacctaaacttacccgaaacgtaccgaaaccggtaccccgttggaccccgtaaggttaccccgttaagggtaaaacttttcgtttttacggaaacctttaaacgtttaactttaacgttacgggtaacctaaaacgttaacggttaccttttaaaagttaccccgtttaaccccgtacgttaccggttacgggtttacccgggggaacgggtaaccggggtaaacccgaaagggggttggaaacgtaaccgttaaacgaaaaacccggtnttaacgggttcggttaccgttaacgacccgttaactagttcccgttagttcccgttcttaacccg

SEQ ID NO: 377124 - DNA, 588 bp, Homo sapiens
  misc_feature: GZ8MTXP01A08LX.13.87.H10.1.454.CMB.2.raw
  modified_base (268)..(268): a, c, t, g, unknown or other
  modified_base (544)..(544): a, c, t, g, unknown or other
  modified_base (556)..(556): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgagactctcctgtgcagcctntggattcacctttgatgtattatgccatcgcacgtcgggtccgacaacgccgtaccgaggggacggccgtggagtggtctcgaggtatagataggaaatgtggagcagtaggctagtcggcggtactcgtaggtacggaacggggtccgtattacccaccgtacttccaccgaacgacgaaaccaacccgtacaaacggtaacccttccgtagtaactcgtagaacctaaatacgaacctagccgtagaagagcgtaggacgacgtacgttcgttnttattgtagaanaacaaagttcctaaccgttaacccgtttaagg

SEQ ID NO: 377125 - DNA, 604 bp, Homo sapiens
  misc_feature: GZ8MTXP01C19YA.13.87.H10.1.454.CMB.2.raw
  modified_base (290)..(290): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagctctcctgtgcagcctctggattcacctttgatgattangccatgcacgtcgggtccgcaagctccgagggacgggccgtggaggtggtctccgaggttattggttggaatagtggtaaggctagtaggctagtggcggtactcgtggtaggaacgggccgtattccaacctatcctaccaagacgaaccaaaccgacccaaacgggtaaccttccccgtagtaacttcgtagacaaaacgttaggaaacacggacctggaacggaaggccgttagggacgacccgacgggttctttaggttatttagttgacgtaacaaaaggtccttacccctaaaccgtttcggtttaag

SEQ ID NO: 377126 - DNA, 827 bp, Homo sapiens
  misc_feature: GZ8MTXP01CW47M.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggactattaacagtttatttagctggtatacaagaacaaaaaccgagggaaacgtcctaaagctcctagatctatgttcgacactcctactttgacgtaaaaggttcgggggtaccccaagttaccgtaaacggttcgaacggtaccccggggaccgtaaaggggtgggtaaacgttaccggttaaacgggggaaacctaagggtaaacttttacccgaaacctttacctacctaaaccaaacgttaccaaacgggaccaaacggtaccccttggtaccgaacggtacccgtttagggtaaaacttagttttttacggaaacctttaaacgttttaacgtttaaccttacggggtttaaaccctaaaccggttaacgttaacctttttaaaacgttaacccgtttaaccccgtacgtttaaccggtaaccgggtttttacccgggggaaccgggtaaaccgggggtaacccgtaaagggggtttaacggaaagggtaaaccttaaccgggtaaaaaaaccggtccgtttaaggggttcgggacctttaaccggaccgtaaacccgtttacgttccgtttaccgttaacccgtttaaccgttaaccg

SEQ ID NO: 377127 - DNA, 792 bp, Homo sapiens
  misc_feature: GZ8MTXP01DTGNN.13.87.H10.1.454.CMB.2.raw
  modified_base (291)..(291): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgcagctggtggagtcgtggggggagtcttggtacagcctggcaggtccctgagactctcctgtgcagcctctggtattctactttgatgattangccatcgctacgtggggtcccgacaacggccgtaccggaagggggaacgggtcccgttagggggaaggttcgggggttacttacggtaagggtttagtttagggtttaggaaaggtttaggtaggttacgacgtaaagttaacgggtcgttaagtcgggaccgggtacccgttcccgggtagggaccgggggtaccctaacgtttcccaaccgtacttccaccgaagaaacgtaacctaaacttacccgaaacgaaaccgaaccgttctttacggtttttaaccgttaacctaaaagttacggaaacctacggtaccccgtaggaaccggtaacggcccggttaaataccgggaacccgtaccggggtaacccgttttaagttacgtttaaaccggttgggttacggtcggaaagggttacggaacggggttaacccggggaaccccgtaaaccggttaaacggttacccgttaccggttaacgttaacggttaaccgggg

SEQ ID NO: 377128 - DNA, 610 bp, Homo sapiens
  misc_feature: GZ8MTXP01CC5HC.13.87.H10.1.454.CMB.2.raw
  modified_base (491)..(491): a, c, t, g, unknown or other
  modified_base (519)..(519): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtatttttccttttggctaattttaaaaggtgtccagtgtgaagtgcagctggtggagtcgtgggggagcttggtacagcctggcaggtccctgagactctcctgtgcagcctctggattcactttgatgattatgccatgcacgtgggtccgcaagctacgaggggacggcctgggagtggtctcgaggtattaggtgaatggtgtagcaagtaggctagcggcgggtactcgtgggtacgaacggggtccctaattccgacattcctaccgaagacgaaccaaccgacccaaagtaaccctcccgtagtaacttcgtagaacctaaagtcgaaaccgngccctaggaacgacgctaggacggaacncgggttcttaggttatttagttgaacgaacttaaaacgccttaaccccgtaacccgtttagttagttttagggtaagttaagtttaaccgg

SEQ ID NO: 377129 - DNA, 572 bp, Homo sapiens
  misc_feature: GZ8MTXP01AKOUQ.13.87.H10.1.454.CMB.2.raw
  modified_base (308)..(308): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggaggcttggtacagcctggcaggtccctgagactctcctgtgcagcctctggattcacctttgatgattatgccatgcactggggtccgnaagctaccgagggggaaggcctggagtgggtctcgaggtattagtggaataggtggtaagctagtagggctagtcggcggtactcgtgtgaacgggccgattcgaacccatcctaccagacgaacaacgccaaagggaactccctgtactctgacaaagtgaaacagaccctgagaagcttaggaacggaccgacgggtccttaggttatttacgtggtacgaacgtaaaaacgtcttacccctaaaccccgtttgtttaacgg

SEQ ID NO: 377130 - DNA, 578 bp, Homo sapiens
  misc_feature: GZ8MTXP01CQRQZ.13.87.H10.1.454.CMB.2.raw
  modified_base (293)..(293): a, c, t, g, unknown or other
  modified_base (443)..(443): a, c, t, g, unknown or other
  modified_base (468)..(468): a, c, t, g, unknown or other
  modified_base (557)..(557): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcactgccggcagtcaggacattaacagtttattagtctggtatcagacaaaaaccgagggaaactccctaagctcctgatctatgttncatccatttgactaaaggtgggtacccagtcaaggttcaggccgcaggtgatcgtagggacaagtaattcactctcaactaatcagcacgcctgacagaccttagaaacgttattttagacttaaactttattactaggtacaaaccgtntaacctttaaataccgttaccccgnttaccgtaaggtttcggggacggtagggacccgtaaagggtcggaaagtacttacgaaaacggtacttgggttcgcgtaagccaacctntccgttagtcctttcgtaacc

SEQ ID NO: 377131 - DNA, 687 bp, Homo sapiens
  misc_feature: GZ8MTXP01A4K3J.13.87.H10.1.454.CMB.2.raw
  modified_base (301)..(301): a, c, t, g, unknown or other
  modified_base (427)..(427): a, c, t, g, unknown or other
  modified_base (433)..(433): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacgttggccggccagtcaggactattaactagtttattagtctggtatacaagaacaaaaacgagggaaactcctaagctctagtatctatgttnactactacctattagacgtaaaggtcgggtaccatacgtaaggtcgaggccggcaggtggatcgtaagggactaagtaactcactctacaacaatcagtcacgcgtagcacgtacgtagtaagttnttttanaccttaaatttagttacctaggtaactaacgtaacgttaaactttaaacgtaaccgtttaccccgtagtttaaccggttacgggtttacccgggggaacgggtaaccggggtaaaccggtaaagggggttaacgggaaacggttaaaccgttaaaccgggtaaaacggtaaaccggttgggttcgggaaccttaaccggaacccgtaaccttaacggtttccgttacgttttaacccgttaacgtttaaccccg

SEQ ID NO: 377132 - DNA, 573 bp, Homo sapiens
  misc_feature: GZ8MTXP01AXBF6.13.87.H10.1.454.CMB.2.raw
  modified_base (296)..(296): a, c, t, g, unknown or other
  modified_base (309)..(309): a, c, t, g, unknown or other
  modified_base (338)..(338): a, c, t, g, unknown or other
  modified_base (374)..(374): a, c, t, g, unknown or other
  modified_base (479)..(479): a, c, t, g, unknown or other
  modified_base (501)..(501): a, c, t, g, unknown or other
  modified_base (519)..(519): a, c, t, g, unknown or other
  modified_base (563)..(563): a, c, t, g, unknown or other
tcagtcacgtactacacgaccggtgctcgatttagcagtactgcgttgggtttggggagctctgggagaggagccccagccctgagattcccaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacntgagctgggtccncaggctccgagggagggctggagtgcgtnttcttttattactagtagtgtagtacaatacctcgnacgactccgtgaggggccattccacatctaccagagacaattaccaagaacacgtcttagtttcttaacaaattcgaaacacgcctgagacgccgatcggaaccnccgggtccgtgttaactttcgngttcgcggaagttacggngttccgggggaaccctaacggaaccgtttacgacgttacttcgngggtaaccgg

SEQ ID NO: 377133 - DNA, 621 bp, Homo sapiens
  misc_feature: GZ8MTXP01EZ39A.13.87.H10.1.454.CMB.2.raw
  modified_base (184)..(184): a, c, t, g, unknown or other
  modified_base (290)..(290): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggngtccagtgtgaagtgcagctggtggagtcgtgggggagcttggtacagcctggcaggtccctgagactctcctgtcgcagcctctggattcacctttgatgattangccatgcacgtgggtccgcaagctccgagggaggctggagtggtctcgaggtattaggtgaactagtggtaagcagtggctagtgcggatcgtgtagaacgggcgattacaccgatctaccgagacgactaaaccgacccaaagggtaacccttccccgtagttacttacgtacgaacctaaacgtagaaaccgaggtacccgtaggaaggaaccgtagttacgggaacgggaaccgtaccgggttacccgttagttaacgtttacgtttaaggaggtaactaaaaacggtcttaaacccccgttaaaccccgttttaaggttttaaaggg

SEQ ID NO: 377134 - DNA, 581 bp, Homo sapiens
  misc_feature: GZ8MTXP01AL48M.13.87.H10.1.454.CMB.2.raw
  modified_base (493)..(493): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagtttatttagtctggtatcaagacaaaaaaccgagggaaactccctaagcctcctgacttctatgttgcatccatttgactaaagggttcggggtaccccagtaccgaaaggttcaaggtccggacagggttgggatcgtaggggaactaaggtaaactttcaacttctacaacaaatccagcaggtccctggcagcctaggaattattttcgacttaacttattaactggtaacaaagtgtaactttaaatcgttacccnttccgtaagttcgggacggagggaccaaggtggagattacgaaaaggtcgttgttcggctgcctaactagtcttgttccttcgtaacc

SEQ ID NO: 377135 - DNA, 602 bp, Homo sapiens
  misc_feature: GZ8MTXP01C5PVO.13.87.H10.1.454.CMB.2.raw
  modified_base (393)..(393): a, c, t, g, unknown or other
  modified_base (428)..(428): a, c, t, g, unknown or other
  modified_base (475)..(475): a, c, t, g, unknown or other
  modified_base (480)..(480): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcgttggtacagcctggcaggtccctgagactctctgtgcagcctgtggattcacctttgatgtattatcgcctatcgcacgtgggtccgacaacgcgtaccgaggggacggtctgggagtgggtactagtaggttattaggttaggaactaggtgtagctaaagtaggcttaagngacggtactcgtggtacggaacgggctaatcaacntccacaagacacaacgacaaacgactcctgtactcgtagactaaagngaacncgcgtagagaagtcaggacggaactccgttcttagttagtttagtgttacgaaacttaaaacggtccttaaacccccgtaacccgtttagttagtttttagggaagtttaacgggttaaacg

SEQ ID NO: 377136 - DNA, 572 bp, Homo sapiens
  misc_feature: GZ8MTXP01B8U3U.13.87.H10.1.454.CMB.2.raw
  modified_base (261)..(261): a, c, t, g, unknown or other
  modified_base (265)..(265): a, c, t, g, unknown or other
  modified_base (393)..(393): a, c, t, g, unknown or other
  modified_base (490)..(490): a, c, t, g, unknown or other
  modified_base (509)..(509): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctntggnttcacctttgatgattatgccatgcacgtcggggtcccggacaaggcctaccgaagggggaacgggcctgggaggtggggtcctgaaggtatttaggttggaattggtggtagcaaagtagggctagngcgggacttcggtgtaggaacgggccgtagttccaccgactcctccgaagacgaacaaccgaccaaacgaacctccctagtactctgacaatgaacngctgagtgctgacggaacncggccttgttattagtgttgacaaagctaccctaacccttagtcgttttggaagttgttaacg

SEQ ID NO: 377137 - DNA, 629 bp, Homo sapiens
  misc_feature: GZ8MTXP01BJPS5.13.87.H10.1.454.CMB.2.raw
  modified_base (258)..(258): a, c, t, g, unknown or other
  modified_base (266)..(266): a, c, t, g, unknown or other
  modified_base (309)..(309): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctatttaaaggtgtccagtgtgaagtgcagctggtggagtcgtgggggagcttggtacagcctggcaggtccctgagactctcctgngcagcctntgattcacctttgatgattatgccatgcacgtggggtcccganaagcctaccgagggggaacgggcctgggaggtcgggtctaccgtaggttatttaggttaggaaagttaggtagggtaagctaaggtaggcttagtcgggcgggtacttcgtaggtaggaacggggtccgtagtttccacctagtcctaccgaagacgaaccaaccgtacccaaagggtaacccttcccgttagtaactccgtacgacctaaagtacgaaactacgccgtaggagtaacgcgttaggacgaccgaacgggtcctttaggttatttagtgtagtaacaaaagcttaccccgtaacccgtttaaggtttaacg

SEQ ID NO: 377138 - DNA, 612 bp, Homo sapiens
  misc_feature: GZ8MTXP01ECF9I.13.87.H10.1.454.CMB.2.raw
  modified_base (310)..(310): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgnaagctccgaggggacggctggagtggtctcgaggtattaggtgaataggtgtaagcagtggctagtggcggtactcgtggtaggaagggcctattccaacccgtatcctacccgagaacgaaccaaaccgacccaaagggtacccttccccgtagtactcgtacgactaaaagtacgaaacctcgaccgtggaacgaagtccgttagggaaacggttacgaccgggtcctttaggttatttagtttggacgtaaacctaaaacggtcccttaccccgtaaaccccgttttaagtttaacggg

SEQ ID NO: 377139 - DNA, 858 bp, Homo sapiens
  misc_feature: GZ8MTXP01DJIFH.13.87.H10.1.454.CMB.2.raw
  modified_base (192)..(192): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagatcaccatcacttgccggcagtcaggactattaacagttattagctggtatcagaacaaaaacgagggaaactccctaagctctgatctatgttcgactactcctatttcggactaaacggggttcggggtacccctaattaccggtaaaggttacgacggaccccgggtactaaggggttggaacttcggtaaacgggggaaacctaagggtaaaccttttacccgaaaccttccgtaacccaaacgtaaacgttacccaacgggaccctaaacgccccgttacgggacctaaccggtaccccgtttaaggtaaaaggttttacgttttttaacgaaaccctttaaaaccgtttttaacgttttaaacccctttaaggggttaaacccgttaaaaaccttaaaccgggttttaaccctttttaaaaaccgttaaaccccggtttaaccccccggtacggttttaaccccgttaagggggtttttaaccccgggggtaccgggggtaaaaccgggggaaacccggttaaagggggttacgggttaaaggttaaacgttaaacgaaaaacccgggttaaggttcgggttaacgggcctttaaccggacccttaacccggttatttacccgttcggtttaacccgtttaaccctttaaccccgg

SEQ ID NO: 377140 - DNA, 590 bp, Homo sapiens
  misc_feature: GZ8MTXP01B4YDJ.13.87.H10.1.454.CMB.2.raw
  modified_base (262)..(262): a, c, t, g, unknown or other
  modified_base (378)..(378): a, c, t, g, unknown or other
  modified_base (497)..(497): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggatttttcctttggcttattttaaaaggtgtccagtgtgaagtgcagctggtggagtcgtgggggagcttgggtacagcctggcaggtccctgagctctcctgtgcagcctntggattcacctttgatgattatgccatgcacgtggggtcccggacaagcctaccggaagggggaacgggtcctgggagtcggggtctcgaggttattaggttggaaatggtggtanctaaagtaggctagtcgacggtacttcgtggtaggaaacgggccgtattccaccatcctaccgaagacgaacaaccgaccaaacgaacctccctagtacgtctagacaaagtacgaacncgctagagtgcgtagacggaacacggttccttagttattagtgagacaaaacgtctaccctaacccttacgtatttaggtaagttggttaacg

SEQ ID NO: 377141 - DNA, 654 bp, Homo sapiens
  misc_feature: GZ8MTXP01CD8W7.13.87.H10.1.454.CMB.2.raw
  modified_base (184)..(184): a, c, t, g, unknown or other
  modified_base (294)..(294): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaggngtccagtgtgaagtgcagctggtggagtcgtgggggagcgttggtacagccgtggcgaggtccctgacgactctcctgtgcagcctctggattccactttgatgtattancgccagtcgctacgtcggggtcccggacaacggccgtacccggagggggaacgggtccgttagggaggtcgggtctaccgtaggttataggatagggaaaattggtggtagcaagtaggctagtggcgtactcgtggtacggagggccgtattccgaactatccgtaccaggtaacaacgtaaaccgacctaaacggtaaccttaccccgtagtaactccgtagaacaaacgtacggtaaaccacgccgtaggaacgaacgcgtaaggaacggtaacccgtacgggttcccttagtttacttaagttaggaacgtaacgtaaaacggttacccttaacccccgttaacccgttttaaggg

SEQ ID NO: 377142 - DNA, 626 bp, Homo sapiens
  misc_feature: GZ8MTXP01BDRBY.13.87.H10.1.454.CMB.2.raw
  modified_base (277)..(277): a, c, t, g, unknown or other
  modified_base (499)..(499): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttcctttggctattttaaaggtgtccagtgtgaagtgcagctgggtggagtcgtgggggagcttgggtacagcctggcaggtccctgagactctcctgtgcacgcctctggattcacctttnatgattatgccatgcagtcgggtccgacaagctccgaagggggacgggcctgggagtgggtctcgaggtattaggtcggaataggtggtagctaagtaggctagtggccgggtactcgtggtaggaaacggggcctagttccaacctatcctaccgaagacgaaccaaaccggaccaaagaacccttacccgtagtacttactggtaacaaactcgaaaccncgaccgtaggagtaagccgtaggaacggaacgtaaccggttcctttgttaagttagtacgttagaacttaaacgaactacccctaaccccgtttagtacgttttacgggaagttaaggtttaaccgg

SEQ ID NO: 377143 - DNA, 704 bp, Homo sapiens
  misc_feature: GZ8MTXP01BKR2M.13.87.H10.1.454.CMB.2.raw
  modified_base (262)..(262): a, c, t, g, unknown or other
  modified_base (283)..(283): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgagactctcctgtgcagcctntggattcactttgatgattangccatcgcacgtcggggtccgacaagcctaccggaagggggacgggccgtgggaggtgggtctcgtaggttattaggtggaaattggtggtagctaaagttaggcttagtcgggacggtactcgtggtagggaaaccgggtcccgtagtttaccacctattccctaccgaaggaacgaaccaaacccggaccaaaacgtaacccttccccgttaggttaacttccgttacggaacctaaaagttacggaaacctacggtacccgttagggaacgtaggaccgtagggaaccgggaaccgtaaccgggttcctttagttaacgtttagttaggttacgttaacttaaaaacggtcccttaaccccgttaaaccccgttttaggttacgtttttaggggtaacggttttaacgggtttaacgg

SEQ ID NO: 377144 - DNA, 547 bp, Homo sapiens
  misc_feature: GZ8MTXP01DX57G.13.87.H10.1.454.CMB.2.raw
  modified_base (285)..(285): a, c, t, g, unknown or other
  modified_base (417)..(417): a, c, t, g, unknown or other
  modified_base (461)..(461): a, c, t, g, unknown or other
  modified_base (529)..(529): a, c, t, g, unknown or other
tcagtcacgtactacacgaccggtgctcgatttagcagtactgcgttgggtttggggagtcccagtcaggacacagcatggacatgagggtccccgctcagctcttggggctcctgctgctctggctcccaggtgccagatgtgacatccagttgacccagtctccatccttctgtctgcatctgtaggagacagagtcaccatcacttgccggcagtcaggactattaacagttatttagctggtatcagacaaaacgaggaatccaagctctgatctatgttncactcctactttgacgtaaaggttcggggtacccagttacgaaagggttcaaggccggcaggtgggatcggtaagggaactaaggtaactttcactctacactaaatcagcagctgcagctagaaacgtttnttacacttaattatactacgtacaatataacttactcgtaccgntacgtggtcggacggacggacgtaaggtgaagtaacttaacgaaacgtgttggcgactcacctaactntcttacgttcttcgtaac

SEQ ID NO: 377145 - DNA, 615 bp, Homo sapiens
  misc_feature: GZ8MTXP01A4RBB.13.87.H10.1.454.CMB.2.raw
  modified_base (272)..(272): a, c, t, g, unknown or other
  modified_base (443)..(443): a, c, t, g, unknown or other
  modified_base (585)..(585): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaagttttaaaggtgtccagtgtgaagtgcagcgtggtggagtcgtgggggagcgttggtacagcctggcaggtccctgagctctcctgtgcacgctcnggtactctactttgatgtatatgccagtgcgtacgtcggggtccgacaacggccgtaccggaagggggacgggtccgtgggagtgggtctacgaggttagttggtagaagtagtaggtgctagtaggctagtcggcggtactgtagtaggaacgggtctattccaaccgtntccgtacaagacgaaccaacgacctaaacgaccttccgtagtaactacgtacgaagtaaacgtacgaacgtacgtccgtaggacggaacgtcgttagggacgaccgtacggtcttaggttacttagtcgtagaacgtaaacnccttaccccgtaacccgttgttttaacggg

SEQ ID NO: 377146 - DNA, 629 bp, Homo sapiens
  misc_feature: GZ8MTXP01C50DO.13.87.H10.1.454.CMB.2.raw
  modified_base (397)..(397): a, c, t, g, unknown or other
tcagtcacgtactacacgaccggtgctcgatttagcagtactgcgttggggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtcggggtccgacaacgcctaccgaagggggaacgggcctgggagtgggtctcgagggttattaggttaggaataaggtggtgctagtagggctagnggcggactcgtggtaggaacggggccgtattaccgaacctatcctaccgagaacgaaccaaaccgacccaaagggtaacccttcccgtagtactcgtagaccaaatacggaacagacctggaagaacggcgttagggaacggaccgtaccgggttcctttagttagttagtttcggaagtaaccgtaaaaacgtcctttaacccccgtaacccccgtttaaggttttaacgg

SEQ ID NO: 377147 - DNA, 666 bp, Homo sapiens
  misc_feature: GZ8MTXP01C6NE5.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggaggtcgttggtacagccgtggcaggtccctgagactctcctgtgcagcctctggattcacctttgattgtattatgccagtcgcctacggtcggggtaccccgacaacggtccgtacccggaagggggaacgggtccgtgggtaggtgggtctaccgtaggttagttaggttaggaacttaagggtggtaagactagtacggctagtcggcggactcgtggtacggaacgggtcctattaccgacctactcctaccgaagacgaaaccgaaaccgacccaaacgggtaaccctccgtagtactacctagactaaagtacgaaacgtagcctaggaacgaacgcgttagggacggacgtaaccgggttctttaggttatttagttaagtacgtaacgtaaaacgtccgttaaccccttaaaccccgtttaaggttttaacggg

SEQ ID NO: 377148 - DNA, 672 bp, Homo sapiens
  misc_feature: GZ8MTXP01BNN8L.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggactattaacagtttatttagtcttaggtatacgaagaacaaaaaaccgagggaaacttccctaaagcctcctagtattctaattgttagctatcctaagtttgacgtaaaggtcgggtaccagtcgaaaggttcgagccggacaggtgatcggtaacgggactaagtaacttccactctacgaacaatcagcacgtccgagacacgtaccgttagtaagttacttttacaacttaaacttttacttacgtttacgggttaaaccaaacgttacgttaacctttaaacgttacccggttaaccccgtgttacccggttacggtttacccggggacgggttaaacgggaaccggtaaggggttacgaacggtaaacttaacggtaaaaccgtgttcgggttcgttacttcgggaacctcttacgtcgttaccgtttaaccttcgttcccg

SEQ ID NO: 377149 - DNA, 622 bp, Homo sapiens
  misc_feature: GZ8MTXP01AM70I.13.87.H10.1.454.CMB.2.raw
  modified_base (234)..(234): a, c, t, g, unknown or other
  modified_base (269)..(269): a, c, t, g, unknown or other
  modified_base (290)..(290): a, c, t, g, unknown or other
  modified_base (309)..(309): a, c, t, g, unknown or other
  modified_base (352)..(352): a, c, t, g, unknown or other
  modified_base (367)..(367): a, c, t, g, unknown or other
  modified_base (372)..(372): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttcctttggcttaattttaaaggtgtccagtgtgaagtgcagctggtggagtcgtgggggagcttggtacngcctggcaggtccctgagctctcctgtgcagcctntggattcactttgatgattangccatgcacgtgggtccanacgctaccgagggacggctggagtgggtctaccgaggtatagngtaggaaattacggnggtanacagtacgggtactagtcggcggtactcgtaggtacggaacgggtcccgtattaccgacctaactcctaccgacgaacgaacgaaccgaaccgtaaacgtaacccgtccctagttactccgagtaaccaaagtagaaacctagacctggaagcggcgtagggaaccggacgtacggttccgtttgttaagttaagtttacggaacgtaacgtaaaacgttaccttaaccccgttaaaccccgttttaagg

SEQ ID NO: 377150 - DNA, 765 bp, Homo sapiens
  misc_feature: GZ8MTXP01BSRAK.13.87.H10.1.454.CMB.2.raw
  modified_base (256)..(256): a, c, t, g, unknown or other
  modified_base (263)..(263): a, c, t, g, unknown or other
  modified_base (285)..(285): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcttggtacagcctggcaggtccctgagactctcctgtncagcctntggtattcactttgatgattangacctatcgcacgtcggggtccgacaacgccgtaccggaaggggaacggggtcccgtaggggtacggttcgggggttacttacggtaaggggttaagtttaagggttagggtaaacgtttagggtaggggttaacgaccgtaaaagttacgggtcttaaggtcgggaccgggtacttcggtagggtagggtaaacgggcccgtattaccaaccctataccgtaccgaaaggaacgaaacccgaaaccgacccaaaacgtaacccttaccctagttaactcgttagaaacctaaaagtacgaaaccgacgtccgtaaggacgacggtaccgtaagggaaccggtaaccgtaaccggggtttcctttaagttaacgtttaagttacggttaacgttaaacgttaaaacggtaacccttaacccccgttaaaccccgttttaggttacgtttttagggtaacggtttaagggtttaaacccgg

SEQ ID NO: 377151 - DNA, 640 bp, Homo sapiens
  misc_feature: GZ8MTXP01BQAC9.13.87.H10.1.454.CMB.2.raw
  modified_base (452)..(452): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgcccagtgtgaggtgcagctggtggagtctgggaggaggcttgatccgagccggtgggggtccctgacgactctcctgtgcacgctcgtcgggtcaccgtcagtcacacctacatgagcgtcggtccgccgacggctccggaggggacggggctgggagtgtcgttcttcttttattatagtagtggtagtaactatcgtccgacacgacctccggtggacggggtcctattccacctatctaccagacgactaatccaaagacncgtctttacgtttctaataaacgttacgaactacgccgtaggaacgacggccgtaagtcgaaccggtacggtaacccggtttagttacgtttaacgttggacggtcgaaaggcggttaacgggtccgggggaccccttaaacggtaacccgggtttacgttaaacccggtgtttaaaggtcccggggg

SEQ ID NO: 377152 - DNA, 719 bp, Homo sapiens
  misc_feature: GZ8MTXP01C0N4B.13.87.H10.1.454.CMB.2.raw
  modified_base (616)..(616): a, c, t, g, unknown or other
  modified_base (658)..(658): a, c, t, g, unknown or other
tcagtcacgtactacacgaccggtgctcgatttagcagtactgcgttgggtttggggagctctgggagaggagcccagccctgagattcccaggtgtttccattcagtgatcagcactgaacacagaggactcaccatggagttgggactgagctggtattttccttttggcttattttaaaaggtgtccagtgtgaggtgcagctggtggaggtcggtggggggggtcttgggtccaggccgtggggggtccctgagactctcctgtgcagcctctggtatttctacgtttaggtaggttagttgggtagttgggggttcggtcccgccagaacctccgagaaggaagggacgtgggaggtggggtacggaccaaacgaagtaaaaggaagagtagggaaagtaggaaaagtgtaactagttgtagcttcgtaggtagggaaacgggtccgtaatttccaacgtacttccgtacccgaaagggaacgaaacccgaaaccggaacccaaaacggtaaccttccgtaaacgttcgttaacttcgtacgacgtaacggtaacgttaccgaacccgtagtcccgtaggaaggtacggtacggaaggtacgtaccgggtnttaaggtttgttagtttaagttggttaagggcgttaaagggngaaccgggtgggtacccgaacggttaacttaggttttacgggtaagttggggtttaacggg

SEQ ID NO: 377153 - DNA, 589 bp, Homo sapiens
  misc_feature: GZ8MTXP01D12XZ.13.87.H10.1.454.CMB.2.raw
  modified_base (283)..(283): a, c, t, g, unknown or other
  modified_base (470)..(470): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcacctttgatgattangccatgcacgtgggtccgcaagctaccgaggggacgggccggagtggtctcgtaggtattaggtggaataggtggtagcagtaagggctgtgccggtactcgtggtaggaaacgggtccgtattcacctatcctaccagacgacaacgccaaagaacctcctagtactcgtagacaaagtcgaaacncgcctagaacgtagcgtaggacggaacaaccggtcttagttattagttgtagaacgaaaacgttactaaccctaaacccgttaagttacgtttggagttaagggtttaacgtaaccggg

SEQ ID NO: 377154 - DNA, 573 bp, Homo sapiens
  misc_feature: GZ8MTXP01DR0EV.13.87.H10.1.454.CMB.2.raw
  modified_base (382)..(382): a, c, t, g, unknown or other
  modified_base (469)..(469): a, c, t, g, unknown or other
  modified_base (484)..(484): a, c, t, g, unknown or other
  modified_base (492)..(492): a, c, t, g, unknown or other
  modified_base (499)..(499): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttcctttggcttattttaaaaggtgtccagtgtgaagtgcagcgtggtggagtcgtgggggagtcttggtacagcctggcaggtccctgacgctctcctgtgcagcctctggattcactttgatgtattatgcctagtcgcacgtcggggtccgacacgcgtaccgaaggggacggctgggagtggtctcgaggtattagtgaataacggtggtaacgnagtaggtctagtggcggactcgtgtaggaaggcgattcactatcgtacaagagacaacgaccaaacgggtaacctccgtagactcgngaaccaatacgactnaccgtagngaacgtnacggagacgtaaccggtcttgttattaagttggaacaactaaaatccttacccttaaacccggttgttttaagg

SEQ ID NO: 377155 - DNA, 624 bp, Homo sapiens
  misc_feature: GZ8MTXP01ELZ8P.13.87.H10.1.454.CMB.2.raw
  modified_base (183)..(183): a, c, t, g, unknown or other
  modified_base (251)..(251): a, c, t, g, unknown or other
  modified_base (263)..(263): a, c, t, g, unknown or other
  modified_base (265)..(265): a, c, t, g, unknown or other
  modified_base (280)..(281): a, c, t, g, unknown or other
  modified_base (283)..(285): a, c, t, g, unknown or other
  modified_base (287)..(287): a, c, t, g, unknown or other
tcagtcacgtactacacgaccggtgctcgatttagcagtactgcgttgggtttgggtagctctgggagaggagccccagccctgagattcccaggtgtttccattcagtgatcagcactgaacacagaggactcaccatggagttgggactgagcgtgtatttcctttaggctatttaaaggngtccagtgtgaagtgcagctggtggagtcgtgggggagtcttggtacagcctggcagtcctgagctcnctgagcagcctngntcacttgatgacttnncnnncncgtcggcgacgacgcgcgaggacggcgtgtagtggtcgtcgtagtagtagtagtagtaagtaggtgagtagtagtagtagtacggtacggtacgtacgtaggtacggacggtacgtacgtaccgtacgtactacgtacgacgacgaaccgaaccgaaccgaaaccggtaaccgttaccgttacgttacgtacgtaaccgaacgtaaacgtaacgaaaccgtacgtacgtacggaacggaacgtacgacggaacggaccgtaccggtacgttagttacgtttagttaagtacgtaacgtaaacgtaaccgttaacccttaacccgttaacgtttaacg

SEQ ID NO: 377156 - DNA, 669 bp, Homo sapiens
  misc_feature: GZ8MTXP01BPLTT.13.87.H10.1.454.CMB.2.raw
  modified_base (274)..(274): a, c, t, g, unknown or other
  modified_base (295)..(295): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagcgtgggtggagtcgtgggggagtcttggtacagcctggccaggtccctgacgtctctcctgtgcagcctntggattcactttgatgattangccatgctacgtcgggtccgcaacggcgtcccgaagggggaagggcccgtagggacgtcggggtcctacgtagggttatttaggtagggaaattaaggtgggtaagctaaggtagggcttaagtcggacggtaccgtcgtaggtaggaacggggtcctaattccgaaccccgtattaccgtacccaaggaacgaaaccgaaaccgaccctaaacggggtaacccttaccccgtaggtaacttccgtacgaactaaacgtcgaaacgtacgccgtaggaagaacgtcgttaggaacggacgtaccggtcgttagttacgttagttaagtacgaacctaaaacgtccgttacccctaacccgtttaacgtttaacg

SEQ ID NO: 377157 - DNA, 553 bp, Homo sapiens
  misc_feature: GZ8MTXP01AU5YS.13.87.H10.1.454.CMB.2.raw
  modified_base (394)..(394): a, c, t, g, unknown or other
  modified_base (397)..(397): a, c, t, g, unknown or other
  modified_base (414)..(414): a, c, t, g, unknown or other
  modified_base (442)..(442): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttgggtacagcctggcaggtccctgagactctcctgtgcagcctctggattcacctttgatgattatgccatgcacgtggggtccggcaagctcccgaggggacgggcctgggagtgggtctccgaggttattagtggaataagtgggtgcagtagggctatgcggactntgngaggcgattcaccatcnccagacgacaacgccaaggaactccctntaactcctgaccaaacgtacgacgtacgacgacgagaagcgaggacggacgacgtcgttagttattagttaagtagaacgaacgtacttaccctaacccgttaacgttaag

SEQ ID NO: 377158 - DNA, 590 bp, Homo sapiens
  misc_feature: GZ8MTXP01AIHMD.13.87.H10.1.454.CMB.2.raw
  modified_base (288)..(288): a, c, t, g, unknown or other
  modified_base (308)..(308): a, c, t, g, unknown or other
  modified_base (505)..(505): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtatttttccttttggcttattttaaaaggtgtccagtgtgaagtgcagctggtggagtcgtgggggagcttgggtacagcctggcaggtccctgagactctcctgtgcagcctctggattcacctttgatgattangccatgcacgtgggtcccgnaagctccgaaggggaagggcctgggagtgggtctacgaggttattaggttaggaattaggtggtagcaaagtagggctagtcggacgggtactcgttggagaacgggccgattcacctatcctccaagagaaccaacgaccaaacgaacctccctagtaacgtctagaccaaatagaaaccagcctagagagtacgngacggaacaacggccttaggttattagtgttacgaacaaaagtccttaccaaccccgtttagtagttttggtaagttggttaacg

SEQ ID NO: 377159 - DNA, 819 bp, Homo sapiens
  misc_feature: GZ8MTXP01BF6XT.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttatttaaaggtgtccagtgtgaagtgcagcgtggtggagtcgtgggggagtcttggtacagcctggcaggtccctgacgactctcctgtgcagtcctctgattcactttgatgtattagcgcctagtcgccgtacggtcggggtccgacaacggtccgtacccgggaagggggaacggggtccgttaggggtaacggttcggggtaccttaccggtaaagggtttagttaaggtagttaggggtaaaaattagggttgggtaagtaccgtaagttacgggtaccgttaagtcgggtaccgggtaacgttcggttagggtaacgggaaacgggggtacccgttaacgtttaccccgaaacccttaacgttcccggtaaaccccgaaagggtaaacccgaaaacccgtaaaaccccgggaacccctaaaaacggtttaacccccggtttaccccttaagggttaaccttaccgttaacgggaaaccctaaaaggttaccgaaaccgacgggttacccgtaagggaaccggagttacccggtaagggaccggtaaacccgtccgggttacgtttggttaacttttaaggtacggtaacggtaaacctaaaacggttacccttaacccccggttaaacccttttaagggg

SEQ ID NO: 377160 - DNA, 831 bp, Homo sapiens
  misc_feature: GZ8MTXP01CNFOK.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagcgtggtggaggtcgtgggggaggtcgttaggtacaggccgtggcgaggtcccctgacgtacctctcctgtcgcacgcctcgtggacttctactttgattgtattatcgaccctagtcgcctacggtcgggggtacccggacgaaacggtcccgtaccgggaagggggaaccgggtccggttaggggtaagggttcggggttactaccggtaaggggtttactttagggaagtagggtaaaagttagggttgggtaacgtacgtaaggttaacgggtccgttaaggtacgggaccgggttaacttcggtacggggtaacgggtaaccgggggtcccttaaacgttacccgtaaaccccgtagttaccccgtaaccggaaaggtaaaccgaaacccgttaaaacccgaacccggtaaaacggttaaaccccctttccccgttaagggttaaacctttccggaacgtaaacctaaaagtaccgtaaacgaccggtacccgtgggaaacggtacgccgggtaggaacggtaaaccccgtcgggttaaccgttttgttaagttttaacgtacgggttaacgaaaacccgtaaaacggttacctaaccccccgtttaaaacccggttttggg

SEQ ID NO: 377161 - DNA, 660 bp, Homo sapiens
  misc_feature: GZ8MTXP01C6FRP.13.87.H10.1.454.CMB.2.raw
  modified_base (277)..(277): a, c, t, g, unknown or other
  modified_base (392)..(392): a, c, t, g, unknown or other
  modified_base (520)..(520): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttccttttggcttattttaaaaggtgtccagtgtgaagtgcagcgtggtggagtcgtgggggaggcgttggtacagccgtggcaggtccctgacgactctcctgtgcacgcctntgattctacttgatgtattatgccatgcagtcgggtccgacaagccgtaccggaaggggacgggccgtagggaggtggtctacgtaggtataggagtaggtaaaattggtggtancgtagtaggctagtcggacgtacgttcgtaggtacggaacgggtccgtaattaccgaacctactaccgtaccgaacgaacgaaacctaaccggaccaaacgtaacccttcccgtagtactccgtaaanaaactaaagtacgaacgacgtacgtaggaacggacgttacggtacggaacggtaccgtacggtttacgtttagtttaacgtttaagttagtaacgtaaacgtaaaaccgttacccgttaaccccgttaaaccgtttaagg

SEQ ID NO: 377162 - DNA, 641 bp, Homo sapiens
  misc_feature: GZ8MTXP01EJC7E.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctcctgtcgcacgcctctggacttctacctttgaatgtattatgccatgcgtacgtcgggggtcccgcaacgccgtacccgaagggggaacgggccgtgggaggtacggggtctaccgtagggttattaggttaggaattaagggtggtaaggctagtaggctagtggcggtacttcgtggtaggaacgggtccgtacttacaaccgtactcctaccaaggaccgaaccaaaccgtacccgaaacgggtaaccttcccgttagtactcctagaccaaatacgaaacacgccgtgaacggaagtccgttaggacgacgtacggtaccttagttattagtttaacgagtaactaaacgtaccttaccctaaaccccgtttggtttaacg

SEQ ID NO: 377163 - DNA, 620 bp, Homo sapiens
  misc_feature: GZ8MTXP01ACC93.13.87.H10.1.454.CMB.2.raw
  modified_base (289)..(289): a, c, t, g, unknown or other
  modified_base (314)..(314): a, c, t, g, unknown or other
  modified_base (358)..(358): a, c, t, g, unknown or other
  modified_base (544)..(544): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagcctggcaggtccctgagcctctcctgtgcagtcctcgtagggttccaccggtcaggtccncacctacatgacgcgtcgggtcccnccgaggcctaccggagggggacgggctgggagtcgcgttctttntttttaattagtagttagtggtatacacgtacctccgaacacgtcctccgggtggaacggggccctattccactatcctaccgaaggaacacctaaattacccaaaggaacctcgtctttgtttactaacgaaatcgaaactgccgtagaagacgccgatcgacgacggtcgtattacgtcgtggngccgaaggcgtacgggtcgggaccccaggttaacggttcacgtcttaggccgggttacgtcggaacggggaacccg

SEQ ID NO: 377164 - DNA, 562 bp, Homo sapiens
  misc_feature: GZ8MTXP01ETVEM.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagatcaccatcacttgccggcagtcaggactattaacagtttattagtctggtatcaagacaaaaccgagggaaactcctaagctcctgatctatgttgctatcctactttgacgtaaaggtcgggggtaccagttacgaaggttcaggtccggctaggtggatcgtagggacaagtaattcactctacacatcagcagctgacagtacctagtaagtatttgactaatttatactggtacaactagtacttaatacgttaccgtcttacgtaggtttcgggacgggacggacgaaggtggaagtaacgttaacgaaacgtacgttggttcgggacttgccaactagtcttacgttccttcgtaaccg

SEQ ID NO: 377165 - DNA, 675 bp, Homo sapiens
  misc_feature: GZ8MTXP01BA8KV.13.87.H10.1.454.CMB.2.raw
  modified_base (263)..(263): a, c, t, g, unknown or other
  modified_base (286)..(286): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcttggtacagcctggcaggtccctgacgactctctgtgcagcctntggtacttcactttgatgattangccatcgcacgtgggtccgacaagcctaccggaagggggacggtccgtgggaggttcgggtctacgaggttagttaggttacggaattaggtcggtagactaagtagggcttagtcgggaccggtactcgtgggtacgaacgggtacccgtattaccgaacctagttacccacgaacgacgaacccgaacgacccgtaaacgaacccttcccgttagtactactaggaacctaaagtacgaaacgcgtaccgtaggacgaacgtcgtacggaacgggtaactaccggttcgttagttaatttacgtgaacgttaaccttaaaaacggttccctaaccccgttaacccgttaggtttaggttttacggaacggtttaacggttaacccgg

SEQ ID NO: 377166 - DNA, 614 bp, Homo sapiens
  misc_feature: GZ8MTXP01EC1DU.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctgggtggagtcgtggggggagtcgttggtacagccgtgggcaggtccctgagactctcctgtgcagctctggattcactttgatgtattatgcctatgctacggtcggggtccgacaaggccgtaccggagggggaacgggccgtgggtaggtcggggtctacggtaggttagttaggtaggtaaagtggtaggtgctagtagggctagtggcgtactcgtagtaggacggcgtagtcactacttccacgagacgaacaacgaccaaggaacctccgtagtactacgtgaacaatagacacgtacctgacgaagtcgacggacggaccgtacggtcgtttaggttatttaagttgggtaactaactaaaacggaccttaacccgttaaaccccgtttaagttttaaggg

SEQ ID NO: 377167 - DNA, 674 bp, Homo sapiens
  misc_feature: GZ8MTXP01A6QGP.13.87.H10.1.454.CMB.2.raw
  modified_base (297)..(297): a, c, t, g, unknown or other
  modified_base (319)..(319): a, c, t, g, unknown or other
  modified_base (583)..(583): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaggtgtccagtgtgaagtgcagctggtggagtcgtgggggagtcttggtacaggcctggcaggtccctgacgtactctcctgtgcagcctctggacttcacctttgatgtattangccatgccagtcggggtccganaacggcctaccggaagggggaacgggcctagggacggtggtccgtacgagggttattagggttagaagttaaggtgggtaagcgtaagtggctaagtcgggaccggtacttcgtagggtacggaaacggggtccctagttcccaaaccctgttacccgtaccgaaacggtaacgaaacccaacccgtaacccgaaacggggtaaaccccttcccgtagttaactaccgttagaactaaacgtagaaaccagtaccgtagaaggngtaccgagggaccggacgtaccgggtctttagttattacgtggtacaaaccgtaaagtcccttaacccgttaacccgtttaaggtttaagg

SEQ ID NO: 377168 - DNA, 632 bp, Homo sapiens
  misc_feature: GZ8MTXP01BRDXF.13.87.H10.1.454.CMB.2.raw
  modified_base (262)..(262): a, c, t, g, unknown or other
  modified_base (284)..(284): a, c, t, g, unknown or other
  modified_base (509)..(509): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctctgtgcagcctntggattcacctttgatgattangcctatcgctacgtcggggtcccggacaaggccgtaccggaagggggacgggtccgtggggaggttcggggtactcgtaagggttatttaggttggaattaggtggtagcgtaagtaggctagtggcgtactgtggtagaacgggcctattccgactactccaccgaagacgaacaaccgaccaaacgaacctccgtagtactactagaactaaagtacaaccgngcctaggagacgtcgtacggacggtaaccgtacggttccttagttaatttacgtgttacgaacttaaaacgtcctaccccttaacccgtttagttagttttaggtaacgtttcggttaaccgg

SEQ ID NO: 377169 - DNA, 644 bp, Homo sapiens
  misc_feature: GZ8MTXP01CF534.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaggtgtccagtgtgaagtgcagcgtggtggagtcgtgggggagcttggtacagccgtggcaggtccctgagctctcctgtgcagcctctggacttcacttgatgattatcgcatgcacgtcgggtccgagaacgcctaccgggaagggggaacggtccgtgggagtgggtactacgtagggttagttagttacggaaagttaaggtacggtaaggactaagtagggtcctaagtcgggcgtaacttcgtagtagggaaacgggcccgtaattcccaacctataccgacgaaggacgtaaaccaacgtaccccaaagggtaaccctaccccttagtactacccgttaacgaactaaagtacgaacgtacgacgtaggacgaacgacgaggaacgacgtaccggttcttagttattagtaagtacgtaaacaaaccgtaccttaccccgtaaccgtttgttaag

SEQ ID NO: 377170 - DNA, 723 bp, Homo sapiens
  misc_feature: GZ8MTXP01ANYB6.13.87.H10.1.454.CMB.2.raw
  modified_base (269)..(269): a, c, t, g, unknown or other
  modified_base (291)..(291): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgacgactctcctgtgcagcctntggattcactttgactgattancgccagtcgctacgtcggggtccgacaacggcctacgaggggacggccgtgggagtggtctcgaggtatagagtaggaaattcggtggtacgctagtacgggcttaagtcggacgtaccgttgtaggtacgggaaaccggggtcccttaagtttaccccgaacctacgttacccgacccgaaaggaaccggaaacccgtaacccggaacccgtaaaacggtaaaccccgttccccgttaaggttaacctccgttaacggaaacctaaaacggttccgaaaccgtacgtaccccgtaagggaacggttaccggacgttacgggaaaccgggtaaccgtaaccccgggtttacgtttggttaaacctttaaggttacggtaacggtaaaactaaacgggttacccttaacccccgttaacccggtttttaacgg

SEQ ID NO: 377171 - DNA, 650 bp, Homo sapiens
  misc_feature: GZ8MTXP01A6UYX.13.87.H10.1.454.CMB.2.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctgggtggagtcgtgggggagtcttggtacagcctggcaggtccctgacgactctcctgtcgcacgcctcgtggattcactttgatgtattatcgcctatcgcacgtcgggtccgacaagccgtacgaagggggacggccgtagggaggtgggtctacgtaggttattaggtaggaaagttcggtaggtacgcgtaaagtagggctagtcgggacgtactgtggtagaacgggccctattccactatccacgaagacgacaacgaccaaagtacctcctagtactcgtagaacctaaagcgaacctgccgtaggagtaacgcgtagggacggtaaccctcgggttctttaggttaaacttgttaagggacgaaaccttaaaacgtcccttaaccccgttaaacccgtttaaggtttagttttacgggtaagggtttaacgtttaaacccggg

SEQ ID NO: 377172 - DNA, 734 bp, Homo sapiens
  misc_feature: GZ8MTXP01CC305.13.87.H10.1.454.CMB.2.raw
  modified_base (266)..(266): a, c, t, g, unknown or other
  modified_base (274)..(274): a, c, t, g, unknown or other
  modified_base (319)..(319): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagctgggtggaggtcgtgggggagtcttggtacagccgtggcaggtccctgacgctctcctgngcagcctntgacttcactttgatgattatgcatcgctacgtcggggtcccganaacgccgtaccggaaggggacgggtccgttgggaggtgggtctacgagggttattaggtaggtaagttaggttgggtaacgataaggttacggtctaagtcggggtaccgtacgttcgttagggtacgggaacggggtacccgtacttacccgaaaccctcgttaccctaccccgaaggaacgaaacccaaaccgaaccccgaaacggggtaaacccctttccccgttaatacccgttagtaccgaaccgtaaaattaccgaaaccgtaacggccctaaggacggaagtcccgttaaggggaaccggttaaccgtaaccccggttcgttttaaacggttacttttaggttaacgtaacgtaacgttaaaaacccctcggtttaaaccccttaaaccccgttttaaggttttaagg

SEQ ID NO: 377173 - DNA, 690 bp, Homo sapiens
  misc_feature: GZ8MTXP01A32A7.13.87.H10.1.454.CMB.2.raw
  modified_base (333)..(333): a, c, t, g, unknown or other
  modified_base (561)..(561): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcggtgggggagtcgttggtacgagccgtggcctaggtccctagacgtacttctccgtgtcgcacgtcctgtggtacttctactttgatgtattatcgacctagtcgctacgtcgggtcccganaacgccgtaccggaaggggacgggtccgtagggtacggtgggtctacggtaggtttagttaggttacgggtaaattaggttgggtaactcgtaaagtacggtcagtcggacgggtacttcgtagggacgggtaacggggccctattccaacctagtcctacgaagacgaaacctaaccggacctaaacgtaccttccgtagtactacgtagaacctaaatacgaaccncgacgtagacgtacgcgtacggacggaacgtcgttagttagttaagttacgtagaacgttaaacgttaaacttaaccctaacccgtttaaccgttagttaggtttacggtaacggtttaacggtaaccg

SEQ ID NO: 377174 - DNA, 643 bp, Homo sapiens
  misc_feature: GZ8MTXP01EDT4E.13.87.H10.1.454.CMB.2.raw
  modified_base (292)..(292): a, c, t, g, unknown or other
  modified_base (315)..(315): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagtcttggtacagcctggcaggtccctgacgactctcctgtgcacgcctctgattcactttgatgattancgccatcgcacgtcgggtccganaacggctacccggaagggggaacgggtccgtagggacggtcggggtctaccggtaggttagttaggttaggaattaagggtggtaagctaagtacgggcttaagtcgggacggtacgttcgtaggtagggaacgggtccgtaattccaaccgtactccgtaccgaagaacgaaccaaacgacccgaaacgggtaacccttcccgttagtactacgtagaaccaaagtacgaacctcgaccgtagacgaagcgttaggacggacgtacggtcttagttatttagtgtacgaactaaacgtccttacccgtaacccgtttaagtttaagg

SEQ ID NO: 377175 - DNA, 677 bp, Homo sapiens
  misc_feature: GZ8MTXP01C0TSB.13.87.H10.1.454.CMB.2.raw
  modified_base (193)..(193): a, c, t, g, unknown or other
tcagtcacgtactacacgaccggtgctcgatttagcagtactgcgttgggtttggggagtcccagtcaggacacagcatggacatgagggtccccgctcagctcttggggctcctgctgctctggctcccaggtgccagatgtgacatccagttcgacccagtctccatccttcctgtctgcatctgtagganacagacgtcaccatcacgttcggccgggccagtcaaggactattaactagtttatttagtctggtatcaagaacaaaacgaggaaactcctaagctactgatctatgtgctactcctatttgactaaacgggttcgggtacccagtacgtaaaggttcgacgccggacgaaggtggtaactcggtaaggggaacaaggtaacttaccacttacacaacactacgacgacacgcctagaccgacgtacctaggtaaattagtttacgaacttaactttacttacgtacgggtaactaaacgtactactttaaacgtacccgttacccgtcttacggtacgggttccggggaacgggtaccggtaaccggtaaagggttggaaaacggttaacgttaaaccgtaaaacggtacgtttaacgggttcgaccgttaacggaaccctaacgtttacgtctttacggttaaccgttaaccgttaaccccg

SEQ ID NO: 377176 - DNA, 660 bp, Homo sapiens
  misc_feature: GZ8MTXP01ARVDN.13.87.H10.1.454.CMB.2.raw
tcagtcacgtactacacgaccggtgctcgatttagcagtactgcgttgggtttggggggagaggagccccagccctgagattcccaggtgtttccattcagtgatcagcactgaacacagaggactcaccatggagttggactgagctggtattttccttttggcttattttaaaaggtgccagtgtgaggtgcagcgtggtggagtcgtggaggaggcttgatccgaggtccggtcgggggtccctgacgtactcctccgtgtcgcacgtccgtcgtggttccaccgtcacgcacacctacagtgacgcgtcggtccgcgacggccgtcggaggggaacgggcgtggagtcgtcgttcttacgtttttattagttagtagtacggtactacactactccgaacacgtccgtcgtagggacgggtcctacgtaccactacgtcctacgaacgaacgtaacctaacttaacgaaacgaacgtaacgtctttacgttacctaaataaagttacaacgacgtccgtagacgacgacgtagtcgaaccgtcggtaccgtagttactcggtgtgacggtagagtacgggcggttacccgttaacggttaaccgttaacgtaccgtaagtacgtacgggttacggtccggttaacgggaacccggg

SEQ ID NO: 377177 - DNA, 779 bp, Homo sapiens
  misc_feature: GZ8MTXP01BR8BG.13.87.H10.1.454.CMB.2.raw
  modified_base (303)..(303): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagtcttggtacagcctggcgaggtccctgacgtactctcctgtgctacgtcctcgtggtacttctactttgattgatttancgccatcgctacgtcgggggtccgacaacggtccgtacccggaagggggaacgggtcccgtaggggtaacggtgggttaccgtacgtaaggggtttagtttagggttagggtaaattaaggggtacgggtaagtaactagggtaacgggaccttaggtccgggacggtacgttcggttaggtaacggggaaacgggggtcctaacgttccgaaacccctagttacccctacccggaaaggaaaccggaacccaaaaccggtaccccgtaaaacggggtaaccccgtttaccccgtaagttaaccttaccgacgtaaacctaaaggttacccgaaacgtaccggaacccgttaggaacggtaaacggtcgttacgggaacggttaaaccgtcccggtttacgtttagttaaacgttttgttaacggagtaaactaaacggtacccttaccccgtaaaccccgttttaagtttaacgg

SEQ ID NO: 377178 - DNA, 710 bp, Homo sapiens
  misc_feature: GZ8MTXP01CICE1.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacgttgccggcagtcagacattaacagtttattagtctggtatacgagaacaaaaccgagggaaactcctaagctctgattctatgtcgctatcctacgtttagacgtaaacgggttcggggtacccctagttacgtaaaggtttcgaacggcccggtacgaggttcggaacgttcggtaacggggaactaagtactttaccaaccttctaacaacgtaactcaacgcaacgtcctggactaggtacccttagggtaaacttacggtttactaacgttaaacttttaacttaacgttacggggttaactaaaaccgttaacggttaaccctttaaaacggttacccgtttaaccccgtacgtttaccggttaacggggtttccgggaaacgggggaaccgggtaaaccgggtaaagggtagggttaacgtaacgttaacgaaaaccgtggttacgttcgggttactaacggacctaacgtactcgttactcctttcgtaacccg

SEQ ID NO: 377179 - DNA, 718 bp, Homo sapiens
  misc_feature: GZ8MTXP01BU7KM.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaaccgtgcagctggtggagtcgtgggggagcttggtacagcctggcaggtccctgagactctcctgtgcagcctctggattcacttgatgattatgccatgcacgtcggggtccgcaacggctaccgaggggaacgggtcctgggacgtgggtcctacgtagggttattaggtaggaagtaaggtggtgctaagtaggctagtcggacggtactcgtagtacggaacggggtcctaattcccgaaccgtattacccgtaccgaaggaaacgaacctaaaccgaccccgtaaaacggggtaacccttccccgttaagtacttacctacggaaacctaaaagttaccggaaacgtaccggtacccttaaggaacggtaacggtcccgttaggggaaaccggaccgtaaacccggggttccctttacggtttaaacgtttagttcgggttaacgtaaacccgtaaaaacgggtccctttaaaccccccgttaaaacccccggtttttaacgggtttttaaaacgggg

SEQ ID NO: 377180 - DNA, 702 bp, Homo sapiens
  misc_feature: GZ8MTXP01DZD0R.13.87.H10.1.454.CMB.2.raw
  modified_base (272)..(272): a, c, t, g, unknown or other
  modified_base (297)..(297): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcgttggtacagcctggcacggtcctgacgactctctgtcgcagcctntggacttctacctttgatgtattangccatcgctacgtcgggtccgacacggctcccgggaagggaacgggccgtgggaggtcggtctacgtagggttattaggtaggaaagttaggtaggtaagactagtagggcttagcggtacgtactcgtagtaggtaacgggccgtacttcgaaccacttaccgtaccgaagacgaaaccgtaaaccgaacccaaacggggtaaacccttccccgttaagttaaacccgttcgttaaccggaaactaaaacgttaacgtaaaccgtaacggacccgttaaggaaaccggaagttacgttaacgggacggttaacccgtaacggtacccgtttagttaacgtttagtttaagtaacggtaaactaaaacgtaccttacccgttaaaccccgttttaagtttaacgg

SEQ ID NO: 377181 - DNA, 604 bp, Homo sapiens
  misc_feature: GZ8MTXP01BH99T.13.87.H10.1.454.CMB.2.raw
  modified_base (192)..(192): a, c, t, g, unknown or other
  modified_base (569)..(569): a, c, t, g, unknown or other
tcagtcacgtactacacgaccggtgctcgatttagcagtactgcgttgggtttggggagtcccagtcaggacacagcatggacatgagggtccccgctcagctcctggggctcctgctactctggctccgaggtgccagatgtgacatccagatgacccagtctccatcctccctgtctgcatctgtagganacagacgtcaccgtcacgttcggccgggacaagtcagaccattgaacaatatagtaaattggtaatacaacagaacgcaggtacaacgccctaagctacctagactactactactcgactacttcctagtttcgcgtacggggccggttacccagttcgtacggttccccgaggctaggtggattcggtaggaactagtactttacgacctactccgaactacttacgacctagtctacgactaacgtagaacgtactgtacactaacttactacgtacggactaacgacttaccgtaaacgccttacgtacttaccggtttcgaccggtaacgggacctagggctaggaactacgacgtaaaacggtcttggggcncgtcactccgtaacttcgttcttcttcgttaaccc

SEQ ID NO: 377182 - DNA, 635 bp, Homo sapiens
  misc_feature: GZ8MTXP01B9LWM.13.87.H10.1.454.CMB.2.raw
  modified_base (297)..(297): a, c, t, g, unknown or other
  modified_base (389)..(389): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctggtaggagacagatcaccatcacgttcgccggcagtcgagactaattaacagtttattagctggtatcaagaccaaaaaacgaggaaacgtcctaagctcctgatctatgtncatcctattgacaaaggtcgggtaccatcgaagttcaggcgcaggtgatcgacgacaagatctactctacacgtaatccatacgacggtccngactagtacgtagtaacttcttataacttaacttacttactacgtaactaacgttaacttaacttaaacgttaccgttacccgtacgtttaccggtttacgggttacggggaacgggtaaacgggtaacggtaaaggggtaacggttaaacgtaaacgttaaaccggtaaacggttacggttcggttacgttaccgtccgtaacctaacgttacgtttccgttaccgtttcctttccgttaacccg

SEQ ID NO: 377183 - DNA, 726 bp, Homo sapiens
  misc_feature: GZ8MTXP01EYY4K.13.87.H10.1.454.CMB.2.raw
  modified_base (272)..(272): a, c, t, g, unknown or other
  modified_base (276)..(276): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagtcttggtacagccgtggcaggtccctgacgactctcctgtgcagcctntggnttctacctttgatgtattatcgccatcgctacggtcggggtcccgagaacgccgtacccgggaagggggtaacgggccgttagggtacggtcgggtctccggtaagggtttagtttaggttaggaagttaacgggtggtaagctaaggtacggcgttaagtggaccgtatcgtggtaggaacggggtcctaattccgaaacctacttaccgaccgaaaggaaccgaaaccctaaaccgaccctaaacggggtaacccttcccggtaagttactacctacgaaactaaacgttaaccggaaacgtacgtcccgtaggaacgtaacggttacgaagggaaccggttaaccgtaccggggttaccctttaggtttaactttagtttaacggaacgtaaacctaaaaacgtccttaaacccccgtttaaaccccgtttaaggtttttaaccggg

SEQ ID NO: 377184 - DNA, 675 bp, Homo sapiens
  misc_feature: GZ8MTXP01B4X2B.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcgttggtacagcctggcaggtccctgagactctcctgtgcagcctctggattcacctttgatgtattatgccatgctacgtgggtccgacaagcctaccggaaggggacgggccgtagggagtgggtctacgagggttatttaggtaggaataggtggtgctagtaggctagtggcgactcgtgtaggaacgggccgtaagttccaaccgtacttaccgtaccgaagaacgaaccgaaaccgacccaaacgggtaacccttaccccgtagtaactacctaggaacctaaaagttacggaaacacggacccttagggaacgaacggtcgttaagggaccgggaaccgtaaacccgggttcctttaacggtttatttaaggtttaaggtacgtaaactaaaaaccgggtaccttaacccccgttaaacccccggttttaacggtttttaacgggg

SEQ ID NO: 377185 - DNA, 683 bp, Homo sapiens
  misc_feature: GZ8MTXP01DOE9E.13.87.H10.1.454.CMB.2.raw
  modified_base (577)..(577): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccctgagactctcctgtgcagcctctggacttcacctttgatgtatttatgccctatcgacctacgtcgggggtacccgacaaacggtccgtaccggaacgggggaacgggtcccgttagggggtacggttcggggtaccttacggtagggtttaagtttagggtttaggaaagttaagggttaggttaaggctaaagtacgggtactagtcgggacgggtacttcgtggtaggaacggggtcctaattccgaacctattccgaccgaaggacgaaaccaaccgacccaaagggtacccttccctagtactcgtagaaccaaatcgaaacngccgtaggagaacgtcttagggacggacgtacgggttctttaaggttcttagttcgtaagaactaaaacgtccttaaccccgttaacccgtttaaggttttaaggg

SEQ ID NO: 377186 - DNA, 612 bp, Homo sapiens
  misc_feature: GZ8MTXP01ACRTP.13.87.H10.1.454.CMB.2.raw
  modified_base (272)..(272): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagtcttggtacagcctggcaggtccctgagactctcctgtgcagcctntggattcactttgatgtattatgccatgctacgtcggggtccgacaacggcctaccgaagggggtaacgggccgtgggagtggggtcctacgtaggttattaggtaggaaattagggtcggtaagctaagtagggctagtggcggtactgtggtaggaacgggccgtattcgacctatcctaccgaaggacaaccaaacgtacccaaagggtaacccttcccgtataactcgtagaacaaagtacgaactcgtacctaggagaagcgttaggaacggaccgtacggtctttagttattagtgacgaaactaaactccttaccctaacccgttaagttaag

SEQ ID NO: 377187 - DNA, 728 bp, Homo sapiens
  misc_feature: GZ8MTXP01CXPKV.13.87.H10.1.454.CMB.2.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagtcgttggtacagtccgtggcacggtccctgagtactctcctgtgcacgcctcgtggtacttctactttgatgtattatcgcctatcgcacgtcggggtccgacaagccgtaccggaaggggacggcgtgggaggtcgggtctgaggttatttaggttggaattggtggtagctaaagtggtcttagtgggtccggtacttcggtagggtacgggaaacggggtaccctagttacccaaccgtacttacccgacgaaacggaccgaaaccgaacccgaacccgtaaacgtaaccctcccgttacggtacttacgtacgaaacctaaaacgtcgaaaccgcgtaccgtaaggacggtaggacctaacggggaacggtaaccgtccggttaccgttttaggttaaactttaggttacgttaacgaaacgttaaaacggtaacccttaaccccgttaaaccccgtttagggtttaacgtttttagggtaacggtttaacgggtttaaacccggg

SEQ ID NO: 377188 - DNA, 650 bp, Homo sapiens
  misc_feature: GZ8MTXP01AZ2KH.13.87.H10.1.454.CMB.2.raw
  modified_base (314)..(314): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcactttgatgattatgccatcgccacgtcgggtcccgganaacgcctaccgagggggaacggccgtgggaggtgggtactaccgtaggttagttaggtaggaattaaggtggtaacgcgtagtaggctagtcggacgtactcgtaggaggaacgggcacgttcacactcaccagacacgaacgccaaacggaccttccgtagtactcgtacgaaactaaagtacgaaccgaggtaccctaggaacgtaacggcgttacggggaaacggttaccgtaccgggttcgtttaaggttaacttttaggtaacggtaacgtaaaccgtaaaaagtaccccgttaaaccccttaaacccccggttttaacgggttttaaggg

SEQ ID NO: 377189 - DNA, 730 bp, Homo sapiens
  misc_feature: GZ8MTXP01DBV90.13.87.H10.1.454.CMB.2.raw
  modified_base (318)..(318): a, c, t, g, unknown or other
  modified_base (576)..(576): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtgggagttcggtggggggaggtcgtttagggtacaggcccgttgggcacgggtcccctagacgtaccttctcctgtgcacgtcctgtggtacttctacctttgattgtattancgcctatcggacctacggttcggggtcccggacaaacggtcccggtaccggaaaggggggaacgggtccgtagggggtacggtcggggttactacggtaggtttaagttaggttaacggaagttaggtggtaagctaaagtgggtctagtcggacgtactcgtagggtaggaacgggctataccgactatcctacgagaccgaacaaccgacctaaacgacccttccgtagtactacgtagaaccaaagtcgaaaccncgtccgtaagaagtcgtacgacggtaaccggaacgtaccggttcgttttaggacttttaggagttaacggaaaccttaaaacggttaacccttaaccccgtaacccgttttaggtttaggttttacgggtaacgggtttcggtttaaacccggg

SEQ ID NO: 377190 - DNA, 747 bp, Homo sapiens
  misc_feature: GZ8MTXP01ENHWO.13.87.H10.1.454.CMB.2.raw
  modified_base (181)..(181): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtatttttcctttggcttattttaaaggtntcagtgtgagtgcagctgggtggagtcggtgggggagtcgttggtacagccgtggccaggtccctgacgtactctcctgtgcacgcctgtggtattcctactttgatgtattatcgcctagtcgctacggtcgggtccggacaacggccgtaccgggaagggggaacgggtccgttagggggtaggttcggggtaccttaggtaagggtttaagtttagggtttacggggtaaagttagggttaccgggtaagacgttaaaggttacggtcgttaagtcgggaccgggtacttcggtaggggtaacgggtaacggggtccctattaccgaacctacttcccgaaccgaaaggacgaaaccaacccggaaccaaacgtacccttcccgtagttaactccgttaagaaaccttaagacgaaaccgcggtcaggacgtagcgtaacgggcgtaaccgtacggttcgtttaggttaattagttacggacgaaaccttaaacggtaaccccttaaccccgttaacccgtttagttacggttttagggtaacggtttaacggttaaaccggg

SEQ ID NO: 377191 - DNA, 734 bp, Homo sapiens
  misc_feature: GZ8MTXP01D50O8.13.87.H10.1.454.CMB.2.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctgggtggaggtcgtggggggagcttggtacagcctggcaggtccctgagactctcctgtgcagcctctggattcactttgatgattatgccatcgacctacgtcggggtccggacaaggtcccgtaccggaagggggaacggggtcccgtagggggtacggtcggggttctacggtaagggttaagtttagggtttacgggaaagttagggtgggtacgacgtaaagttacgggtctaagtcgggaccggtactcgtgggtacgggaaacgggtccgtattaccaacctactacgtacccgaaggaacggaaaccaaccggaacctaaacgtaaccttacccgttagttaactaccgttagaacctaaaagagaaaccgaggtcccgtaaggagacggtccgtaagggaacgggtaaccgtacgggttacccttagttaaagtttagttaggaacgttaaacgttaaaacgtccgttaaacccctaaacccgtttacggttagttttacgggtaagtttaacgggtttaacccgg

SEQ ID NO: 377192 - DNA, 622 bp, Homo sapiens
  misc_feature: GZ8MTXP01E0KVP.13.87.H10.1.454.CMB.2.raw
  modified_base (268)..(268): a, c, t, g, unknown or other
  modified_base (326)..(326): a, c, t, g, unknown or other
  modified_base (356)..(356): a, c, t, g, unknown or other
  modified_base (534)..(534): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggtatttttccttttggcttaattttaaaaggtgtccagtgtgaagtgcagctggtggagtcgtgggggaggtcttggtacagcctggcacggtccctgacgctctcctgngcacgcctctggacttctactttgatgtattatgccagtcgctacgtcggggtccganaacgccgtaccggagggggacggccgtggnggtcggtctcggaggttagttaggttaggaagttaaggtgggtgtacgtagtacggtctagttcggcggtactcgtggtaggaacgggtcgtacttcgaacctctcctaccgaagacgaaccaaccgaaccaaacggtaaccttacccgtgtactctagacaaatacgaacgatccgngagaagtcgaggacgttaccgtacgtcgttgttactttgtaagtacgtaaacaaacgtaccttaacccgttaaccgtttcgtttaagg

SEQ ID NO: 377193 - DNA, 772 bp, Homo sapiens
  misc_feature: GZ8MTXP01CPUWI.13.87.H10.1.454.CMB.2.raw
tcagtcacgtactacacgaccggtgctcgatttagcagtactgcgttggggtttggggagctctgggagaggagcccccagccctgagattcccaggtgtttccattcagtgatcagcactgaacacagagactcaccatggagttgggactgagcttggtatttttccttttggcttaattttaaaggtgtccagtgtgaagtgcagcgtggtggagtcggtgggggagtcgttggtacagccgtggcacggtccctgacgctctcctgtgcacgtcctgtggattcacctttgatgtatactgcccagtcgccgtacggtcggggtacccgacgaacggtccgtacccgggaagggggaacgggtccgtagggacggtcggggtcttaccggtaagggttaagtttaggttaggtaaagtaagggttaggtaacggtacgtaaagggttacgggtaccgttaaggacggggtaccgggtaaccgttcggttaaggggtacggggtaaaccggggtcccgttaaccgtttacccgaacccttacgttaccgtaaccccgaaggaaaccgaaacccgaaaccgaaccccgtaaacggggtaaaccccttacccgttacgtaacgttaccgtacgaaacttaaacgtaacggaaactaccgtaccgtagaacgaacggtacgacggtaacggaaccgtacgggtctttagttatttagtaagtacgtaaactaaaacgtccttaaccccgttaaacccgtttaagtttaacgg

SEQ ID NO: 377194 - DNA, 614 bp, Homo sapiens
  misc_feature: GZ8MTXP01DKU6X.13.87.H10.1.454.CMB.2.raw
  modified_base (295)..(295): a, c, t, g, unknown or other
  modified_base (313)..(313): a, c, t, g, unknown or other
  modified_base (395)..(395): a, c, t, g, unknown or other
  modified_base (504)..(504): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttccttttggcttaatttttaaaaggtgtccagtgtgaagtgcagctggtggagtcgtgggggaggcttggtacagcctggcaggtccctgagactctcctgtgcagcctctggattcactttgatgattangcatgcagtcgggtccgnaagctacgaggggacggctggagtggtctcgaggtattagataggaaattagtggagcagtaggctagtggacgtacttcgnggtacgaacgggtccgtattaccgaacctataccaccgaaagacgaaaccgaaccggaccaaaacgtaccttacccctagtaactccgagaactaaaactcggaaaccncgacctaggaacggacgcgtagggaacggtaccgtaccggttcgtttgttaacgtttgttagtaacgtaaacaaaacggttacttaaccccgttaaaccccgttttaagg

SEQ ID NO: 377195 - DNA, 738 bp, Homo sapiens
  misc_feature: GZ8MTXP01ECBIY.13.87.H10.1.454.CMB.2.raw
  modified_base (605)..(605): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaggtgtccagtgtgaagtgcagcgtggtggagtcgtgggggagtcttggtacagccgtggcgaggtccctgacgtactctccgtgtcgcacgtcctcgtggtacttcctaccgtttgattgtatttatcgcctagtcgccgtacggttcggggtacccgacgaacggtccgtaccgggaagggggtacgggtccgtagggtaggttcgggtctaccggtaggtttagttaggttaggtaagttaagggtagggtaacgagtaagttacgggtactaaggtcggacgggtaccttggtagggtacgggaaacggggtccttacgttacccaaccgttactaccgtaccgaaagaaccgaaaccgaaaccgaacccgtaaacgtacccgttcctaggttactcgtaacgaactaaagtacgaacncgtctaggaacgtaacgcggttaagggaccggttaccgtacgggtttactttagggttactttacggttggaaacgaaaccttaaaacggtcccctttaaaccccgttaacccggtttttaaggttttaaggg

SEQ ID NO: 377196 - DNA, 788 bp, Homo sapiens
  misc_feature: GZ8MTXP01DAZWC.13.87.H10.1.454.CMB.2.raw
  modified_base (602)..(602): a, c, t, g, unknown or other
tcagtcacgtactacacgaccggtgctcgatttagcagtactgcgttgggtttggggggggagaggagccccagccctgagattcccaggtgtttccattcagtgatcagcactgaacacagaggactcaccatggagttgggactgagctggtatttttcctttggcttaattttaaaggtgtccagtgtgaagtgcagtcgtgggtgggaggtcggtgggggggagtcgtttgggtacaggccgtgggcctacgggtcccctaggacgtacttcctccgtgtcgcacgtcccttcgtggtactttcctaccgtttgattgtaatttagcgacctagtcgacgtacggtcggggtcccggacaacggtccgtaccggaagggggaaccgggtccggtaggggtaggtcgggttactacggtaaggttatttagggttaggaagttagggtggtagacgtaaagtacgggtctagtcggacggtactcggtagggtacgggacgggtactacgttaccacctatcctaccgaagaacgaaccgaaccggaccaaacgtaacccgtacccgttagtacttcgtaagaactaaagtacgaaacncggtaccgtaagacggacgcgtacggaacgggtaaccgtaccgggttacctttaaggttatttaacgttaacggttaacgttaaaaccgttaaaaccggttaaccccttaaaccccctttaaacccggtttttaacggttaaggttttttacgggtaacggggttttaaccggtttaaacccgggg

SEQ ID NO: 377197 - DNA, 668 bp, Homo sapiens
  misc_feature: GZ8MTXP01D5QWU.13.87.H10.1.454.CMB.2.raw
  modified_base (290)..(290): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacctttgatgattangccatcgctacgtcggggtcccgacaacggcgtccggagggggaacgggccgtgggagtggggtctacgagggttagttggtaggaagtaaggtgggtaagcgtagtagggctagtcgcggtactcgtggtaggacgggcctattacgacctatccgtacgaagaacgaaccaaaccgaccctaaacggggaaccccttcccgttacgttaacgtcctaacggacctaaagtaacgaaccgagtaccctaggacggaagtacgttcgggaacggttaaccgcgggttaccctttagggttacttttagtttaaggtacgtaaaccgtaaaaacggtacccttaaccccgtttaaaccccgtttaacggtttttaaggg

SEQ ID NO: 377198 - DNA, 860 bp, Homo sapiens
  misc_feature: GZ8MTXP01BTALA.13.87.H10.1.454.CMB.2.raw
  modified_base (288)..(288): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtatttttcctttggacttattttaaaaggtgtccagtgtgaagtgcagctggtggagtcgtgggggagcttggtacagcctggcaggtccctgagctctcctgtgcagcctgtggtattctacctttgatgattancgcatcgactacgtggggtcccgacaaggccgtacccggaaagggggaacggggtcccgttagggggtaacggttcgggggttaccttacggtaaggggtttaagttttaggggttaacgggtaagtttacggggttagggttaacgaccgtaaaaggtttaacggggtcccgtttaaaggtcggggaccggggttaaacccctttcgggttacgggggtttaaacggggaaacccggggggtacccgttaaacttttaaccccgaacccgttacgttaccccgttacccggtaaaggaaaccgggttaaaccccaaaacccgggtaaccccgaaaacgggtaaccccttaccccgtttaaggttaacgttacgttacggaaaccctaaaggttaccgaaacgtaccggtaccgtaggaacggtacgtacggttacggaacgggtaacccgtaccgggttactttaggttaatttagttacggttaacgaaccgttaaaacgtaacccttaaccccgtaaacccgtttacggttaggtttttacgggtaacggtttcgggtttaaacccggg

SEQ ID NO: 377199 - DNA, 860 bp, Homo sapiens
  misc_feature: GZ8MTXP01EHA4O.13.87.H10.1.454.CMB.2.raw
  modified_base (289)..(289): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggctattttaaaaggtgtccagtgtgaagtgcagctggtggactcgtgggggagtcttggtacagcctggcaggtccctgagactctcctgtgcacgcctgtggtacttcacctttgatcgattancgcctatcgcacgtgggtccgcgaagcctacggaagggggaacgggtccgtgggaaggttcgggttctacgtaaggggttatttacggttaggtaaacttaggttggtaacgcgtaaaagttacgggtccttaaagggtcgggacccgggttaaccttcgggtacggggtacgggtaaacgggggtcccttaacgtttaccgaacccgttaacttccccgttaccccggaaaaagggtaccccggaaaccgtaaacccccggtaccccgaaaaaacgttaccccgttacccccgttaagggttaccgttaccttaaaccggggaaactaaaaccgttacggaaacccgtaaacgggtcccgtttaaacggggaaggtaccggtaaccgtacggggaaacccggggttaaacctaaccccgggggtttttacgtttaacgtttaaacgtttacggttaaccggttaaacggttaaaacccgttaaaacggtttaaccccttaaccccgttaaaccggttttacgggtttaacgggtttttacggggtaaccggttttaacggtttaaccggg

SEQ ID NO: 377200 - DNA, 666 bp, Homo sapiens
  misc_feature: GZ8MTXP01CDM1O.13.87.H10.1.454.CMB.2.raw
  modified_base (245)..(245): a, c, t, g, unknown or other
  modified_base (259)..(259): a, c, t, g, unknown or other
  modified_base (294)..(294): a, c, t, g, unknown or other
  modified_base (551)..(551): a, c, t, g, unknown or other
  modified_base (553)..(553): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagtcgttggacagccgtggcaggtcccngacgctctcctgtncacgcctcgtggtacttctacctttgatgtattancgcctatcgcacgtcgggtccgacaacgtccgtaccggaaggggacggcgtagggacggtcgggttctacgtaggttagtttagggtacggtaagttaggtggtagactaagttacgggtctagtcgggtacggtacctgtagggtacgggaacgggtcccgtattaccaaccgtactcctacgaagaacgaaccaacgtaaccaaacgtaccctcctagtactactagtaaacaaagtcaaacgcgtacagaacgngngtacggacgaacgtcgttacgttagttatttagtgttacgaaacaaacgttaacctaaccccgttaaccgtttggttaacgttttagggtaacgttaacgggtttaaacccgg

SEQ ID NO: 377201 - DNA, 776 bp, Homo sapiens
  misc_feature: GZ8MTXP01C9SKU.13.87.H10.1.454.CMB.2.raw
  modified_base (187)..(187): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagagactcaccatggagttgggactgagctggtattttccttttggcttaattttaaaaggngtccagtgtgaagtgcagcgtgggtggagtcgtgggggagcgttaggtacagccgtggcacggtccctgagcctctcctgtgcagcctctggattcactttgatgtattatgccatcgcctacggtcgggtccgacaaggccctaccgggaagggggaacgggtccgtaggggtacggtcgggggtacctaccggagggtttaaagttagggaagttaacggggtaaaaagtttaacggggttgggttaaacgccgtaaagggttacggggacctttaagggtcggaccgggtaacttcggttagggtacgggaaaggggtccccgttaaattacccgaaacccttacttacccgtacccgaaaggaaaccgaacccgttaaaccgggacccgtaaaaccggtaacccctttaccccgtagtaaacttccgaacgaaaccgtaaaagtacgtaaaccgcgtacccgaggaacgtaacggcgttaacggaaacgggtaaccgtacggttaccgttttgttaaacgtttaagttaacgtaagtaaaccgtaaaacggttacccttaacccgttaaaaccccgtttttaagg

SEQ ID NO: 377202 - DNA, 746 bp, Homo sapiens
  misc_feature: GZ8MTXP01EFYEI.13.87.H10.1.454.CMB.2.raw
  modified_base (227)..(227): a, c, t, g, unknown or other
  modified_base (425)..(425): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcttggtacngcctggcaggtccctgagctctcctgtgcacgtcctgtggacttctactttgatgtacttagtcgcctatcggcctacggtcggggtcccgacaaggcccgtaccggaagggggtacgggtccgtagggggtacggttcggggttaccttaggtaagggtttatttagggtttaagggaaagttagggttacgggtanacgtaaaggttaagggtcttaagtcgggacccggtaacttcggtagggtacgggtaaaccgggtcccgtaatttacccgacctattccgaccgaagaacggaaccaaccggtaaccaaacgtacccttacccgtagttactcgtacgaacctaaagtacgaaacgtcgaccgtaaggacgtagaccggtaggaacgggtaacctaccgggttcctttaagtttatttagttcgttaacggaaccttaaaacggtccttaaaccccgttaaccccgtttaaggtttacggttttagggtaacggttttaacggtttaaccgg

SEQ ID NO: 377203 - DNA, 757 bp, Homo sapiens
  misc_feature: GZ8MTXP01BS46L.13.87.H10.1.454.CMB.2.raw
  modified_base (311)..(311): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagcgtggtggagtcgtgggggagcttggtacagccgtggccaggtccctgagactctccgtgtcgcagtcctcgtggacttctaccttttaggattaggtatttaacgngcccctaaagtggtccaccggttcgggggtacccgacgaacggtcccgtacccggaagggggtaacgggtccgttagggtacggtgggggttcctccggtaggttattacggttagggaattaagggtagtaagtaccaggttagggcctaggtacgggcggtaacgttcgtgggtacggaaacgggggtcctacttacccggaaaccgttctacccgttaacccggaaaggtaaccgaaaccgtaaacccgggtacccaaacgggggtaaaccctttccccggttaacgtaccgtaccgttagaaacccgttaaaagtccgggaaaccacggtccgttaaaggacggtaacggtccgttaagggaccggttacgacccgggtttcttacggttattcgttaagacgtaacaaacggtccttaccccttaacgttaacgtttaagg

SEQ ID NO: 377204 - DNA, 533 bp, Homo sapiens
  misc_feature: GZ8MTXP01A3VXY.13.87.H10.1.454.CMB.2.raw
  modified_base (388)..(388): a, c, t, g, unknown or other
  modified_base (398)..(398): a, c, t, g, unknown or other
  modified_base (401)..(401): a, c, t, g, unknown or other
  modified_base (403)..(404): a, c, t, g, unknown or other
  modified_base (442)..(442): a, c, t, g, unknown or other
  modified_base (495)..(495): a, c, t, g, unknown or other
  modified_base (507)..(507): a, c, t, g, unknown or other
  modified_base (509)..(509): a, c, t, g, unknown or other
  modified_base (511)..(511): a, c, t, g, unknown or other
  modified_base (514)..(514): a, c, t, g, unknown or other
  modified_base (519)..(519): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggactattaacagtttatttagctaggtatcaagaacaaaaaccgagggaaactccctaaagctcctgatctatgttgacactaccgactttgactaaaggttcggggtaccattacgaaaggttcaggccgcagtggatcgtagggaacaaggaattcagttcanaacaatcagnacncnncacacgtatatattagtactaacttattatagtacaanatactaatacgtaaaaaacgtactcgtagtggacggacggaagaaggagaganaacgaacgaagngngngtncaacntcttctcgttcgtc

SEQ ID NO: 377205 - DNA, 558 bp, Homo sapiens
  misc_feature: GZ8MTXP02G43FO.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtctgggggaggcttggtacagcctggcaggtccctgagactctcctgtgcagcctctggattcacctttgatgattatgccatgcacgtgggtccgcaagctccgagggaaggcctggagtgggtctcgaggtattagtggaatagtggtgcataggctagtgcggactctgtggaagggccgattccgaccatcctaccaagacgaacaaaccgaccaaagacctccctgtatcctagacaaatgaaacagcctgaagagcgtagacggaacgacggtaccttggtaatttagttgttacggaactaaaaacggtctaacccctaaacccccgtttaacgtttaacg

SEQ ID NO: 377206 - DNA, 549 bp, Homo sapiens
  misc_feature: GZ8MTXP02FYTDZ.13.87.H10.1.454.CMB.2.raw
  modified_base (347)..(347): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagctggtatcagcaaaaaccagggaaatccctaagctcctgatctatgttgcatccactttgcaaagtggggtcccatcaaggttcagccggcagtgatctgggacngaattcactctcacaatcagcagcctgcagcctgaagtattttgactaactttattacctgttacaaactagtacctttaaatacgttaacccgcttacgtaaggtttccgggacgggtaaggggacctaaagggtgggaagaacgttaacgaaaacggtaacgttaggtcggactggaccaacctatctcgtacttctaac

SEQ ID NO: 377207 - DNA, 546 bp, Homo sapiens
  misc_feature: GZ8MTXP02F44PJ.13.87.H10.1.454.CMB.2.raw
  modified_base (336)..(336): a, c, t, g, unknown or other
  modified_base (381)..(381): a, c, t, g, unknown or other
  modified_base (441)..(441): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaactccctaagctcctgatctatgttgcatccatttgctaaaggtcgggtcccatcaaggtcagccgnagtgatctaggacagaattcactctacacaatcagcagcctgacngcctgaatatttgactaacttattactagtacaacagtaccttaaagtaccgttacccgnttacgtagtttccgggacgggagggtaccgaaagggtggaagtacgtacgaaaacggtactagggtcgactcggaccaacctacgtccttagtcctttactaccg

SEQ ID NO: 377208 - DNA, 522 bp, Homo sapiens
  misc_feature: GZ8MTXP02HT8NW.13.87.H10.1.454.CMB.2.raw
  modified_base (332)..(332): a, c, t, g, unknown or other
  modified_base (347)..(347): a, c, t, g, unknown or other
  modified_base (358)..(358): a, c, t, g, unknown or other
  modified_base (436)..(436): a, c, t, g, unknown or other
tcagtcacgtactacacgaccggtgctcgatttagcagtactgcgttgggtttgggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccatttgcaaagtgggtccatcaaggttcagccggnagtggatctgggacngaattcatctnacaatcagcagcctgcagcctgaagattttgacaaactttattactgtacaaacagtactttaaatgtttaaccccgnttcaaggttttccgggacggtaaggggaccaagggttggaagactacgaaaacgaactggtaggctgcacctatctgtctttacac

SEQ ID NO: 377209 - DNA, 597 bp, Homo sapiens
  misc_feature: GZ8MTXP02JBZQQ.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagcaaaaaccagggaaagtccctaaagctcctgatctatgttgcatccactttgcaaaagtgggtccatcaaggtcagcgcagtgatctggacagaattcactctcacaaatcagcagcctgcagcctgaaagattttgactaaactttattactgtacaaactagtactttaaaatacggtttaacccccgacttacgtacggtttaccggggaacgggtaacgggaaaccgtaaaaggggtacggaaacgtaacgtaaaccgaaaaacggtaacgttacgggtacggtacgtaacggaaccctaaaccgtacgttacccgttacggtttacccttacgtaaccg

SEQ ID NO: 377210 - DNA, 549 bp, Homo sapiens
  misc_feature: GZ8MTXP02IRKM5.13.87.H10.1.454.CMB.2.raw
tcagtcacgtactacacgaccggtgctcgatttagcagtactgcgttgggtttgggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagctctcctgtgcagcctctggattcacctttgatgattatgccatgcacgtgggtccgcaagctccgagggaggcctgggagtgggtctcgaggtattaggtggaatgtggtagcagtaggctatgcgactctgagaggccgatcacatctcagagacaacgcaaagactcctagtatctgacaaatacgaacagacctaggaagacgcgtaggaacggacgaccgggtaccttgttaattagttgtacgaactaaaagtaactaccctaaacccgtttagtagtttttacggacgttaggtttaacg

SEQ ID NO: 377211 - DNA, 542 bp, Homo sapiens
  misc_feature: GZ8MTXP02IHHRY.13.87.H10.1.454.CMB.2.raw
  modified_base (266)..(266): a, c, t, g, unknown or other
  modified_base (305)..(305): a, c, t, g, unknown or other
  modified_base (364)..(364): a, c, t, g, unknown or other
  modified_base (385)..(385): a, c, t, g, unknown or other
  modified_base (411)..(411): a, c, t, g, unknown or other
  modified_base (453)..(453): a, c, t, g, unknown or other
  modified_base (466)..(466): a, c, t, g, unknown or other
  modified_base (475)..(475): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtctgggggagcttggtacagcctggcaggtccctgagactctcctgtgcagcctcnggattcacctttgatgattatgccatgcactgggtccgnaagctccgaggggaaggcctgggagtggggtctcgaggtattagatggaatgtgggtancatagggctagtgcggactcngtagaaggggccaattcaccattccnccaagacgaaccaacgcccaaagaacctccctagtactccgngacaaatgaaacngcctgacgngcaggacggaccgacgtctttagtatttaagttgacgaacaaaagtaccttacccgtaaccctttag

SEQ ID NO: 377212 - DNA, 554 bp, Homo sapiens
  misc_feature: GZ8MTXP02JAS3M.13.87.H10.1.454.CMB.2.raw
  modified_base (409)..(409): a, c, t, g, unknown or other
  modified_base (455)..(455): a, c, t, g, unknown or other
tcagtcacgtactacacgaccggtgctcgatttagcagtactgcgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttgggtacagcctggcaggtccctgagactctcctgtgcagcctctggattcacctttgatgattatgccatgcacgtgggtccgcaagctccgagggagggcctgggagtgggtctcgaggtattaggttggaataggtggtagcagtaggctatggcggactgtggtggaagggccagttccaccgtatcnccagacacaacgaccaagaacctcccgtagtactcgtagactaaanagaacagtccagacgagcgtagacggacacggtcttagtattagttgtacactaaaagcctaaccgtaacccttagttactttggacgtttggttaacg

SEQ ID NO: 377213 - DNA, 514 bp, Homo sapiens
  misc_feature: GZ8MTXP02IQ9YI.13.87.H10.1.454.CMB.2.raw
  modified_base (416)..(416): a, c, t, g, unknown or other
  modified_base (434)..(434): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagacaaaaaccgagggaaagtccctaagctcctgatctatgttgcatccatttgacaaaggtcgggtcccatcaaggtcagccgcagtgatcgagggacagaattcactctacaacaatcaagcagcctgcagctagaagtatttgactaattatactgtacaanagtacttaatacgtaccnttcaggttcggacgagggaaccaagggtcggaatactacgaaaacgacgtgtcgactgactacatcgtcgtactactacg

SEQ ID NO: 377214 - DNA, 562 bp, Homo sapiens
  misc_feature: GZ8MTXP02HQHYJ.13.87.H10.1.454.CMB.2.raw
  modified_base (194)..(194): a, c, t, g, unknown or other
  modified_base (295)..(295): a, c, t, g, unknown or other
  modified_base (390)..(391): a, c, t, g, unknown or other
  modified_base (401)..(401): a, c, t, g, unknown or other
tcagtcacgtactacacgaccggtgctcgatttagcagtactgcgttgggtttggggagtcccagtcaggacacagcatggacatgacgggtccccgctcagctccgtggggctcctgctgctctggctcccaggtgccagatgtgacatccagttgacccagtctccatccttcctgtctgcatctgtagganacagagtcaccatcacttgccgggcagtcaggacattaacagttattagtctggtatcagacaaaaaccgagggaaactcccaagctcctgatctatgttncatcctatttgacaaaggtcggggtaccatctaaggtcagccggacaggtggatcgtaggggactagaaattcacttcacacaaatcagcagccnncacgacgtanagtattactactaacttattatatactaactatacttaactacgttaccgtactacgtacggttacggtacgggacgggaacggtaacggtaggaagaacgtaacgaaacgaaacgtacgtacggtacgtaacgacaactactactacgttacttactacg

SEQ ID NO: 377215 - DNA, 593 bp, Homo sapiens
  misc_feature: GZ8MTXP02JLELU.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagacaaaaaccagggaaatccctaagctcctgatctatgttgcatccactttgcaaaaggttcggggtacccatcgaaggttcagccggcagtggatcgtagggacagaacttcaactctacaacaatcagcagcctgcagcctagaagtatttgacttaattattactagtacaacgtagtactttaaagtacgtttacccgacttacgtaggtttccgggacggggtaagggaacccgtaaggggttaggaaagtaacgttaacgaaaaacgggtaacctgggttacggaccttaaggacccaaaccgtacttccgttacgttaccctttacttaacccg

SEQ ID NO: 377216 - DNA, 615 bp, Homo sapiens
  misc_feature: GZ8MTXP02GIPUB.13.87.H10.1.454.CMB.2.raw
  modified_base (304)..(304): a, c, t, g, unknown or other
tcagtcacgtactacacgaccggtgctcgatttagcagtactgcgttggggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttgggtacagcctggcaggtccctgagactctcctgtgcagcctctggattcacctttgatgattatgccatgcacgtgggtccgnaagctccgaggggaaggcctgggagtggggtctcgaggttattaggttggaataggtggtagcatagggctatggcggtactcgtggtaggaaagggccgtattcacctatctaccagacgacaacgcaaacgactaccctagtatctagacaaatacgaaacagtacctggaagagactaggaacggaaccgtacgggtccctttaggttaactttaacgtttagtacgtaactaaaaacggtaacctaaccccgtaaaaccccctttaacggtaacgtttttacgggtaacggtttaggtttaaaccgg

SEQ ID NO: 377217 - DNA, 543 bp, Homo sapiens
  misc_feature: GZ8MTXP02GFIAW.13.87.H10.1.454.CMB.2.raw
  modified_base (378)..(378): a, c, t, g, unknown or other
  modified_base (407)..(407): a, c, t, g, unknown or other
tcagtcacgtactacacgaccggtgctcgatttagcagtactgcgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttgggtacagcctggcaggtccctgagactctcctgtgcagcctctggattcacctttgatgattatgccatgcacgtgggtccggcaagctccgagggaggcctggagtgggtctcgaggtattagttggaatgtggtagcattaggctagtgcggactntggtgaaacgggccgattcaccatctcanagacaacgccaaagactaccctgtactctgacaaatagaacagacctagaagagctagacggacgacggtccttagtattagttgtagacaaaagctaccctaaaccttacgtagttttacggagttcggttaacg

SEQ ID NO: 377218 - DNA, 601 bp, Homo sapiens
  misc_feature: GZ8MTXP02G7CQ5.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagcaaaaaccagggaaagtcccctaagctcctgatctatgttgcatccactttgcaaagtgggtccatcaaggtcagcgcagtgatctggacagaattcactctcacaatcaagcagcctgcagcctgaagattttgactaaactttattactgtacaaacagtacctttaaatacggtttaaccccgcttacgtaacgggtttccgggacggggtaacgggtaaccgtaaaaggggtacggaaacggtaaacgtaaaccgaaaaaaccggtaacgttacgggtaacgggtaccgtaacggaccctaaacccgtacgtttaccgttacggtttaccctttaccgtaaccg

SEQ ID NO: 377219 - DNA, 620 bp, Homo sapiens
  misc_feature: GZ8MTXP02HESEE.13.87.H10.1.454.CMB.2.raw
  modified_base (289)..(289): a, c, t, g, unknown or other
  modified_base (337)..(337): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcacctttgatgattangccatgcacgtgggtccgcaagctccgaggggaggcctggagtggtcncgagtattagtggaataggtggtgctagtaggctagtggcggtactcgtaggtggaacggggccgtattcccgacctatcctaccgaaggacgaaccaaaccggcccaaaagacccttcccgtagtaactctacgactaaaagtcgaaacacggacctaggaacggaagccgtagggaacgggaacccgtacgggtacccgtttaggttaacttttaagttcggttaaggaaacctaaaaacggtaccttaccccctaaaacccccggtttacggtttaacgg

SEQ ID NO: 377220 - DNA, 507 bp, Homo sapiens
  misc_feature: GZ8MTXP02JFBK2.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagcctggtatcagcagaagccagggagagtccctaaattattgatctctgctgcgtccgctttgcaagtcggggtccatctcggttccagtggcggtggatctaggcagaattcactctcaccatcaccaaacctgcaccctgaagatgtggtaaagtttattaactggtcagtacctataggtggtggcccgctcaagtttcggcggtagggaccaaggtgacgagactacaaacgaacgtgtggctgcaccatctctcttctacc

SEQ ID NO: 377221 - DNA, 545 bp, Homo sapiens
  misc_feature: GZ8MTXP02JQWCT.13.87.H10.1.454.CMB.2.raw
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctggggagcttggtacagcctggcaggtccctgagactctcctgtgcagcctctggattcacctttgatgattatgccatgcactggggtccggcaagctccgaggggaagggcctgggagtggggtctcgaggtattaggtggaatagtggtagcagttagggctagtggcggactgtggtgaagggccattcgacatctcagagacaacgccaagaactccctgtactctgacaaatagaacagacctgagagctgaggacacggccttgtattagttgtacgacaaaagtaactacctaaaccccttagtactttttacggagtttacggttaacg

SEQ ID NO: 377222 - DNA, 527 bp, Homo sapiens
  misc_feature: GZ8MTXP02IUP6U.13.87.H10.1.454.CMB.2.raw
  modified_base (289)..(289): a, c, t, g, unknown or other
  modified_base (306)..(306): a, c, t, g, unknown or other
  modified_base (351)..(351): a, c, t, g, unknown or other
  modified_base (504)..(504): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggagcttggtacagcctggcagggtccctgagactctcctgtgcagcctctggattcacctttgatgattangcatgcactgggtccgnaagctccgagggaggcctggagtggtctcgagtatgtgaatgtgngcagtaggctagtgcggactcgtgtaggaagggccgattccacgtatctaccagacgacaaacgccaaagaacctccctagtatctgacaaaatgaaacacgctagacgagcaggacggacacggtccttagttattattgtagaactaaaanactaccctaacccttagttaacg

SEQ ID NO: 377223 - DNA, 540 bp, Homo sapiens
  misc_feature: GZ8MTXP02FS5CS.13.87.H10.1.454.CMB.2.raw
  modified_base (379)..(379): a, c, t, g, unknown or other
tcagtcacgtactacacgaccggtgctcgatttagcagtactgcgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttgggtacagcctggcaggtccctgagactctcctgtgcagcctctggattcacctttgatgattatgccatgcactgggccgcaagctccgaggggaggcctgggagtgggtctcgaggtattaggtggaatagtggtagcataggctatgcggactctgngaagggccgatcacatctccagacgacaacgccaaagaactccctgtatctgacaaaatgaaacagcctgaagaccccgatagaggacacgggccttgtaattattgtagacaaaagaactaccctaaccccttacgtagttttcggaagttggtttaacg

SEQ ID NO: 377224 - DNA, 509 bp, Homo sapiens
  misc_feature: GZ8MTXP02JQF93.13.87.H10.1.454.CMB.2.raw
  modified_base (438)..(438): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcagacaaaaaccagggaaagtccctaagctcctgatctatgttgcatccactttgacaaagtgggtcccatcaaggttcagccggcagtggatcgtgggacagaattcactctacacaatcagcagcctgcagcctgaagtattttgactaacttattactgtacaacagtcttaaatacgttacccgntcgagtttcggacggtaggaccaagggtgagactacgaaaacgactgtggctggcacatctcgtctactac

SEQ ID NO: 377225 - DNA, 555 bp, Homo sapiens
  misc_feature: GZ8MTXP02JZQFL.13.87.H10.1.454.CMB.2.raw
  modified_base (362)..(362): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggaggcttggtacagcctggcaggtccctgagactctcctgtgcagcctctggattcacctttgatgattatgccatgcacgtgggtccggcaagctaccgaggggaaggcctgggagtgggtctcgaggtattagtggaatgtggtancagtaggctagtgcgatcgtggtagagggccgattcacctatctccagacgaacaacgaccaaagaacctcccgtagtaactctagacaaagtgaaacagcctagagagctagacgacgacggtcttaggtattagtgtagaacaaaagctaccctaaacccttagtacgttttacggagttacgtttaacgg

SEQ ID NO: 377226 - DNA, 637 bp, Homo sapiens
  misc_feature: GZ8MTXP02IHBZH.13.87.H10.1.454.CMB.2.raw
  modified_base (530)..(530): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcttggtacagcctggcaggtccctgagactctcctgtcgcagcctctggattcacctttgatgtattatgccatgctacgtcggggtccggcaacggcctacccggaggggaacgggccgtaggggagttggggtctccgtagggttattaggttaggaagttaggtggtagctagtagggcttagtcggacggtacttcgtggtaggaaacggggtcctaattcccgacctagttcctaccgagaacgaacaaaccggacccaaaaggacccttcccgtagtaactctacgaacaaatcgaaacncgaccgtaggaacgtagacgtggaacggaccgtaacgggtcctttaaggttatttaagtggtacgaaactaaaagtccctaacccttaaacccgtttaggtttaagg

SEQ ID NO: 377227 - DNA, 642 bp, Homo sapiens
  misc_feature: GZ8MTXP02IVWEV.13.87.H10.1.454.CMB.2.raw
  modified_base (303)..(303): a, c, t, g, unknown or other
  modified_base (337)..(337): a, c, t, g, unknown or other
  modified_base (356)..(356): a, c, t, g, unknown or other
  modified_base (478)..(478): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcttggtacagcctggcaggtccctgagactctcctgtgcagcctctggattcacctttgatgattatgccatgccagtgggccgnaagcctaccgaggggaaggcctgggagtggtctnaggtattgtgaatgtggancagtagggctagtcggacggaccttgtggtaggaaacggggccgtattccaccatcctaccgagacgaacaaccgaccaaacgaccttcccgtagttactcgttgaccaaagtacgaaaccncgtacctaggaaacgaggaccgtagggaacggtaaccgtaccggggtcccttttaggttaactttagtttggtaacggaacctaaaaaacggtccttaaccccctaaaaccccgttttaaccggtttagttttttacgggaaggtttacggttttaaacccggg

SEQ ID NO: 377228 - DNA, 560 bp, Homo sapiens
  misc_feature: GZ8MTXP02JBM8G.13.87.H10.1.454.CMB.2.raw
  modified_base (363)..(363): a, c, t, g, unknown or other
  modified_base (407)..(407): a, c, t, g, unknown or other
  modified_base (453)..(453): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcaagacaaaaacgagggaaatcccctaagctcctgatctatgttgcactcctatttgactaaaagggtcgggtacccagtacaaggttcagccggacaggtgatcgagggaacngaattcactcacaacaatcagcagtcctgcagcctagaaagttntttgacttaattatactgtacaactagtacttaataccgttacccnttacgtacggtttacggacgggaaggaccgtaagggtacggaaagacgtaacaaaacggtactcggtacggcctaagaccctaactacgtctacgttactctaaccc

SEQ ID NO: 377229 - DNA, 534 bp, Homo sapiens
  misc_feature: GZ8MTXP02JEL3K.13.87.H10.1.454.CMB.2.raw
  modified_base (271)..(271): a, c, t, g, unknown or other
  modified_base (310)..(310): a, c, t, g, unknown or other
  modified_base (369)..(369): a, c, t, g, unknown or other
  modified_base (375)..(375): a, c, t, g, unknown or other
  modified_base (382)..(382): a, c, t, g, unknown or other
  modified_base (386)..(386): a, c, t, g, unknown or other
  modified_base (392)..(392): a, c, t, g, unknown or other
  modified_base (452)..(452): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagcgtggtagtttcctttaggctattttaaaaggtgtccagtgtgaagtgcagctggtggagtctgggggagcttgggacagcctggcagggtccctgagactctcctgtgcagcctcnggattcacctttgatgattatgccatgcactgggtccgnaagctcccgaggggaaggcctgggacgtgggtctccgaggttattagagttggaatagnggtagnatagggntagngcgatntgagaggctatcactatcacagacgacaacgaccaacgacctcctagtactcgagacaanacgaacacgacgagacgagacgacgacggacgacgtacgtagtagttaagtgtacgtacgaacgtactacctaaccgttacg

SEQ ID NO: 377230 - DNA, 520 bp, Homo sapiens
  misc_feature: GZ8MTXP02HJL8U.13.87.H10.1.454.CMB.2.raw
  modified_base (383)..(383): a, c, t, g, unknown or other
  modified_base (432)..(432): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagttattagcctggtatcagcagaagccaggagagtccctaaatattgatctctgctgcgtccgccttgcaagtccggggtccagtcgtcggttcagtggcggtggatcgtaggacagtaatcactctcacactcacaactgcaccctgaantgttggtaatttatacgtgtactagtaaccttagtagtgggtcgcccgntcgtagtttcggacgggaggtaccgaaggtcgacgaggactacgaaaacgtacgtggtacggctcggcaacctactctcgtcttactc

SEQ ID NO: 377231 - DNA, 670 bp, Homo sapiens
  misc_feature: GZ8MTXP02IK4XB.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggtcgttggtacagccgtggcaggtccctgagactctcctgtgcagcctctggattcacctttgatgattatgccatgcacgtgggtccgcaagcctaccgaggggaaggcgtggagtcgggtctcgaggttattaggtaggtaataggtggtagcgaagtaggtacttaagtcggacgtactcgtggtaggaaacggggcctaagttcccaaccatacctacccgaagaacgaaacctaaaccgacccgaaaacgtaaaacccttccccgttaaggtacttacccgtaggaaccaaaattacggaaaaccacggtaccctaaggaacggtagaccgttagggaaacggaaaccgtaccgggttacccttttaggtaactttaagttcggttagaaaacgtaaaaacgtaccttaccccctaaaacccccgttttaggtttaacgg

SEQ ID NO: 377232 - DNA, 681 bp, Homo sapiens
  misc_feature: GZ8MTXP02ILUNS.13.87.H10.1.454.CMB.2.raw
  modified_base (380)..(380): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttccttttggctattttaaaaggtgtccagtgtgaggtgcagctggtagagtcgtgggggaggtggtggtacgggccgtggggggtccctcagactctcctgtgcaacctctggattcagatttgatgagtatggcatacacgtgggtcccaccaacctccgaggggaagggctgcaggtgggtctcgtggtataaacgtggaatggtgccccagcaacaacttangcagactctggtaggaaggggccaattccaaccctatcctaccaaggagaaccaggtcgaccgtaaagaaacccttccgtaacactccttaggaaacctaaaagttcggaaaaccgtacggttccgttaacggggaacggttaccggaaacggggtaaccctaaccgggggttccctttagggttttactttacggttgggtacggtaccgggtaagggttttacgaccggttaagggtcgggtaacgtttacgggtaaaccgtttaccgacgtaagtacgggggtaaccgtttccggggg

SEQ ID NO: 377233 - DNA, 662 bp, Homo sapiens
  misc_feature: GZ8MTXP02G8MU9.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcagacaaaaaccagggaaatccctaagctcctgatctatgttagctatccacttttgacgtaaaaggttcggggtaccccagtacgaaagggtttcaacggcccggaccgtaaggttggggaacttcggtagggggaacagggtaaactttcaaccttacctacaaaccaaaattccaaacggccaaacggtccccttaaggccaaacgggtcccttagggaaaacggttttacgttttaacgaacttaaactttaacttaacgtagtaacctaaacgtacgttaactttaaacgtaccgttacccgtacttacgtacggttcgggacgggtaacgggtaacgtaagggtagagtaacgtaacgaaaacgtacgtacggtcgacgtcgacactacgtactcgttacttactac

SEQ ID NO: 377234 - DNA, 616 bp, Homo sapiens
  misc_feature: GZ8MTXP02IIQ0G.13.87.H10.1.454.CMB.2.raw
  modified_base (304)..(304): a, c, t, g, unknown or other
  modified_base (379)..(379): a, c, t, g, unknown or other
tcagtcacgtactacacgaccggtgctcgatttagcagtactgcgttgggtttggggggagaggagccccagccctgagattcccaggtgtttccattcagtgatcagcaactgaacacagaggactcaccatggagttgggactgagctggattttccttttggcttattttaaaaggtgtccagtgtgaagtgcagctggtggagtctgggggagcttgggtacagcctggccaggtccctgagactctcctgtgcagcctctggattcactttgatgattatgccatgcacgtgggtccgnaagcctaccgaggggaacggcctgggagtgggtctcgaggtattaggtcggaattggtggtagcaagtgggctancggcggtacttcgtggtaggaaacgggccgtaattcacctatctaccagacgacaacgaccaaagacctccctagtactctagacaaatacgaacagtccgtgagagtacgtagacggtaccgtacgggtccttaggttaactttacgttaggtacgtaacaaaaacgtaaccttaacccccttaaaccccgtttaacggttacgtttttacgggtaacggtttaggtttaaaccgg

SEQ ID NO: 377235 - DNA, 561 bp, Homo sapiens
  misc_feature: GZ8MTXP02GU6TR.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcagacaaaaaccagggaaactccctaagctcctgatctatgttgcatcctatttgacaaaggtcggggtacccagtacaaggttcaggccggcagtgatcgtgggacagaattcactctacacaatcagcagctgcagctgaagtatttgactaattattacgtgtacaaacagtacttaaagtacgttaacccgcttacgtaggtttccggacggagggtaccgaaggggttcggaagtaacgtaacgaaaaccgtacgttaggtcggtacgtaaggacctaaccagtttccgtacgttcctttactaccg

SEQ ID NO: 377236 - DNA, 581 bp, Homo sapiens
  misc_feature: GZ8MTXP02IMD60.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctgggtggagtcgtgggggagcttggtacagcctggcaggtccctgagactctcctgtgcagcctctggattcacctttgatgattatgccatgcacgtggggtccggcaagctaccgaggggacggcctgggagtgggtctcgaggtattaggttggaattaggtggtagcagtaggctagtggacggtactgtgaggagggcattcaccatcaccagagacaaacgaccaaagaacctccctagtactactagacaaatagaaactagacctggaacgacgacgtaggaacggaccgtaacggtccgtttagttaactttagttgtacgaacgtaaaaacgtacgttaccccttaaacccgtttacggttttaacg

SEQ ID NO: 377237 - DNA, 558 bp, Homo sapiens
  misc_feature: GZ8MTXP02IS23D.13.87.H10.1.454.CMB.2.raw
  modified_base (358)..(358): a, c, t, g, unknown or other
  modified_base (399)..(399): a, c, t, g, unknown or other
  modified_base (448)..(448): a, c, t, g, unknown or other
  modified_base (494)..(494): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcaagacaaaaaccagggaaactccctaagctcctgatctatgttgcatcctactttgactaaaggtcggggtcccagtacaaggttcagccggcagtgatcgtgggacngtaattcactctacacaatcagcagcctgcagctagaagtntttgactaatttattacctgtacaacgtagtcttaaactcgttacccgnttcgtaacggtttcggggacggaacgggaccgaaaggggttggaanaacgttacgaaaacggtacgttcggtaggactcggactaaccctagttcttcgttacttactac

SEQ ID NO: 377238 - DNA, 535 bp, Homo sapiens
  misc_feature: GZ8MTXP02ITBUS.13.87.H10.1.454.CMB.2.raw
  modified_base (264)..(264): a, c, t, g, unknown or other
  modified_base (284)..(284): a, c, t, g, unknown or other
  modified_base (350)..(350): a, c, t, g, unknown or other
  modified_base (355)..(356): a, c, t, g, unknown or other
  modified_base (361)..(361): a, c, t, g, unknown or other
  modified_base (365)..(365): a, c, t, g, unknown or other
  modified_base (374)..(374): a, c, t, g, unknown or other
  modified_base (460)..(460): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagcgtggatttcctttggctatttaaaggtgtccagtgtgaagtgcagctggtggagtctgggggagcttggacagcctggcaggtccctgagactctcctgtgcagcctcnggattcactttgatgattangcatgcacgtgggtccgataagctccaggggagctggagtgggtctcgaggtatgatggaatacgnggtannagagntagngcgatgtgngacggctatcactatcacgagacgactaacgacaacgtactcctagtactcgtgaactaaagtacgaacacgtacgtagacgacgngtacgacggacgacgtacgttagttagttaagttacgtacgtaacaaacgtaacgtaacccttaacccgttaacg

SEQ ID NO: 377239 - DNA, 535 bp, Homo sapiens
  misc_feature: GZ8MTXP02IUPTY.13.87.H10.1.454.CMB.2.raw
  modified_base (307)..(307): a, c, t, g, unknown or other
  modified_base (365)..(365): a, c, t, g, unknown or other
  modified_base (446)..(446): a, c, t, g, unknown or other
  modified_base (471)..(471): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtgggggagcttggtacagcctggcaggtccctgagactctcctgtgcagcctctggattcacctttgatgattatgccatgcacgtgggtccgnaagctaccgaggggaaggcctggagtgggtctcgaggtatagatggaatagtgggtancagtaggctagtggcgactcgtggtagaggggcctagttcaccatctacagacgacaacgccaaagtacctcctgtactcngacaaatcgaacacgtcaggagacncgaggacgacaccgggtacttgtattaagttgtagacaaaagtcctaaccctaacccgtttaag

SEQ ID NO: 377240 - DNA, 687 bp, Homo sapiens
  misc_feature: GZ8MTXP02IG3G5.13.87.H10.1.454.CMB.2.raw
  modified_base (269)..(269): a, c, t, g, unknown or other
  modified_base (366)..(366): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctcnggattcacctttgatgattatgccatgcactgggtccgcaagctccgaggggaaggcctggagtgggctccgaggtattaggtgtaatggtggtacnaataggctaagtgacgggtactcgtggtaggaaacgggggcccgtaagttcccgtaacccggttccccgttaacccggaaacgggggacccaaaaccgttaaccccaaaacggtaaacccctaaacccctttaattaactaccttaggaccaaaggaacttaggaaaactacgggaccccttagggaaacggaacggggttaggaaacccggtaaccgttaccggggtaccctttgggttaaacttaacccggtttttcgtagggtaacgtaaccggtaaaaccgtaaaacgtagttacggtaacggtttagggtttaggg

SEQ ID NO: 377241 - DNA, 589 bp, Homo sapiens
  misc_feature: GZ8MTXP02H9YN2.13.87.H10.1.454.CMB.2.raw
  modified_base (291)..(291): a, c, t, g, unknown or other
  modified_base (333)..(333): a, c, t, g, unknown or other
  modified_base (393)..(393): a, c, t, g, unknown or other
  modified_base (403)..(403): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggattttccttttggctattttaaaggtgtccagtgtgaagtgcagctggtggagtcgtgggggaggcttggtacagcctggcaggtccctgagactctcctgtgcagcctctggattcacctttgatgattangccatgcacgtcgggtccggcaagcctccgaggggaaggccnggaggtcgggtctccgaggtatttagttaggaattaggttggtagcagtaggctagtggngactcgtggnggtaacggggctagttccaccgatctcccagacgacaaacgcccaaagaacctcccagttataccgtgaacaaatcgaaacacgcctagaagacgcgtaggaacggacgacgggttaccttaggtttacttagttaagacgtaaacgtaaaacgtcttaacccctaaacccgtttacgtttaacgg

SEQ ID NO: 377242 - DNA, 580 bp, Homo sapiens
  misc_feature: GZ8MTXP02G11MD.13.87.H10.1.454.CMB.2.raw
  modified_base (293)..(293): a, c, t, g, unknown or other
  modified_base (351)..(351): a, c, t, g, unknown or other
  modified_base (370)..(370): a, c, t, g, unknown or other
  modified_base (399)..(399): a, c, t, g, unknown or other
  modified_base (450)..(450): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcaagacaaaaaccagggaaactccctaagctctgatctatgttncatccatttgactaaaggtcgggtacccatacgaaggttcaggccggcagtggatcgnggacagattcactctacanaatcagcagcctgacagcctagaacgttntttcgactaactttatactgtacaactagtactttaaagtaccgttacccncgttacgtaaggtttccgggacgggtaacgggaacctaaaggggtcggaaagacgttaacgaaaacggtaacgtggtacggtctaacggacctaaacccgttacgttccgttacgtttccttacgtaccg

SEQ ID NO: 377243 - DNA, 553 bp, Homo sapiens
  misc_feature: GZ8MTXP02HYIII.13.87.H10.1.454.CMB.2.raw
  modified_base (288)..(288): a, c, t, g, unknown or other
  modified_base (412)..(412): a, c, t, g, unknown or other
  modified_base (415)..(415): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcactttgatgattangccatgcacgtcgggtccgcaagctccgaggggacggccgtaggaggtgggtctcgaggttattaggtagaagtggtggtagctagtaggctagtgcgtactgtgtggaacggctattccgacntcncagacgacaacgcaaagacctcctagtactctgactaaatcgaaacagccgtagacgacgctagggaacggtacacggtccttagttaagttagtgtacgaaacaaaacgtactacccctaaacccgtttagttaagg

SEQ ID NO: 377244 - DNA, 563 bp, Homo sapiens
  misc_feature: GZ8MTXP02IQMLD.13.87.H10.1.454.CMB.2.raw
  modified_base (477)..(477): a, c, t, g, unknown or other
  modified_base (503)..(503): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctatttaaaggtgtccagtgtgaagtgcagctggtggagtcgtgggggaggcttggtacagcctggcaggtccctgagactctcctgtgcagcctctggattcacctttgatgattatgccatgcacgtgggtcccgcaagctccgagggaggcctggagtggtctcgaggtattagtgaatagtgtgcataggctagtgcggtactcgtgtggaagggccgtattccaaccacttctacccgaagacgacaaaccggacccaaaggaaccctcccctaggtactccgtagaccaaaatcgaaacngacctgacgtacgctaggacggaacncggtccgttagtatttagtgtacgaactaaaacgtctacccgtaaccctttaggtttacg

SEQ ID NO: 377245 - DNA, 573 bp, Homo sapiens
  misc_feature: GZ8MTXP02JGX3A.13.87.H10.1.454.CMB.2.raw
  modified_base (310)..(310): a, c, t, g, unknown or other
  modified_base (480)..(480): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtccgnagctcgagggaggcctggagtgggtctcgaggtattagtggaataggtggtgcagtaggctagtgcggactcgtggtagaaggggccctattccgacctacgtcctacccagacgaccaaaccggaccaaacggaacctccccgtagtactcctagaccaaatcgaaacngaccgtagaacgagcgtaggaacggacacggtcctttaggtatttagttgtagaacgtaaaagtcctacccgtaaacccctttagtttaacgg

SEQ ID NO: 377246 - DNA, 583 bp, Homo sapiens
  misc_feature: GZ8MTXP02GC7QL.13.87.H10.1.454.CMB.2.raw
  modified_base (308)..(308): a, c, t, g, unknown or other
  modified_base (361)..(361): a, c, t, g, unknown or other
  modified_base (543)..(543): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgagactctcctgtgcagcctctggattcactttgatgattatgccatgcacgtgggtccgnaagctccgaggggacggcctggagtcgggtctcgaggtatagtggaatggtgngcagtaggctagtgcgggtactcgtggtaggaacggggtccgtattccaaccacgtcctacccgagaacgaaccaaacggacccaaacggaccctcccgtagttaactctagaaccaaatacgaaacacggacctaggagaagtctaggaacggacaccggtcctttagtatttagtggtanaacgtaaaacgccttaccctaaaccccgtttagtttaacg

SEQ ID NO: 377247 - DNA, 623 bp, Homo sapiens
  misc_feature: GZ8MTXP02H29LP.13.87.H10.1.454.CMB.2.raw
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccctgagactctcctgtgcagcctctggattcacctttgatgtattatgccatgcacgtcggggtccgcaaggccgtaccgaggggtaacgggccgtggggacggtggggtcctcgtagggttatttaggttaggaattggttggtgctaagtaggctagtcgcggtactcgtgtggaacgggccgtattccgacctatcctaccgaagacgaacaaaccggaccaaacgtaacccttcccgtagttactcgtagacaaaagttcgaaacacgtccgagacgtacgcgtaggacggtaaccgaccggttcttacgttattaagttgtacgtaaacaaaacgtacctacccccgttaaacccgtttaggtttaacgg

SEQ ID NO: 377248 - DNA, 609 bp, Homo sapiens
  misc_feature: GZ8MTXP02FXDCM.13.87.H10.1.454.CMB.2.raw
  modified_base (260)..(260): a, c, t, g, unknown or other
  modified_base (375)..(375): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgagactctcctgngcagcctctggattcactttgatgattatgccatgcacgtggggtccgacaacgcctaccgaggggacgggcctgggagtgggtctcgaggttatagataggaattaggtggtanctagtaggctaagtggcggtactcgtggtaggaaacggggccgtaacttccgaacctattacctacccgaagacgaaaccgaaacccgaccaaaaccggtaacctaccccttagtaactccgtagaacctaaatacgaacacgccgtagagacgacgtggaacggacgacgggtaccttaggttacttaagttagtagaaactaaaacgtacctaaccctaacccgtttaacgg

SEQ ID NO: 377249 - DNA, 561 bp, Homo sapiens
  misc_feature: GZ8MTXP02G2LGO.13.87.H10.1.454.CMB.2.raw
  modified_base (256)..(256): a, c, t, g, unknown or other
  modified_base (261)..(261): a, c, t, g, unknown or other
  modified_base (412)..(412): a, c, t, g, unknown or other
  modified_base (416)..(416): a, c, t, g, unknown or other
  modified_base (422)..(422): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcngcctntggattcacctttgatgattatgccatgcacgtggggtccggcaagcctaccgaggggagggcctgggagtgggtctgaggtattaggtggaataggtggtacgctagtagggctagtggcggtactcgtgtgaacgggccgtattccacntccnccaganacaacgacaaaacgactaccctgtatctagacaaatagaacagcctagagagctaggacgacgacggtcttagtattattgtacacgaaaagtaactaccctaaacccgttacgtagttttacggacgttagtttaacg

SEQ ID NO: 377250 - DNA, 642 bp, Homo sapiens
  misc_feature: GZ8MTXP02FMQG3.13.87.H10.1.454.CMB.2.raw
  modified_base (300)..(300): a, c, t, g, unknown or other
tcagtcacgtactacacgaccggtgctcgatttagcagtactgcgttgggtttgggggagagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacttgatgattatgccatgcactgggtccgnaagctcgagggaggcctggaggtggtctgaggtattaggtagaataggtggtagctagtagggctagtcggaccggtacttcgtggtagggaaacgggcccgtaattccaacctatcccgtaccgaggaacgaaccaaaccgacccaaaagaaacctccccgtagtaactcgtacaacgtaaaatcgaaacagccgtaggagacgcgtacgggaaacggtaccgaccgggttcctttaaggttaacttttaacgtttggtacggaaaactaaaaaggtaccctttaacccccgtaaaacccccgtttagtttaaacgtttttacggggtaagttttaacggg

SEQ ID NO: 377251 - DNA, 810 bp, Homo sapiens
  misc_feature: GZ8MTXP02GNM96.13.87.H10.1.454.CMB.2.raw
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacctttgatgatttatgccatgcacgtcggggtccggcaacggctacccgaggggaacggggtccgtaggggacggttggggtctcgtaagggttatttaggttagggaaattaggttaggggtagacgtaagttagggcttaagtcgggccggggtacttcgtggtacgggaaacgggggtcccgtaagtttcccgaaccctacttcccgtacccgaaggaacgaaaccgaaacccggaacccgaaaacgtaaacccttaccccgttacggttaactaccgttacggaacctaaaagttacgaaaaccgaacgtacccgtaagggaacgtacggtaccgtaacggggaaacgggtaccgtaaccccgggggttacccgttttaacgggtttaaacttttaacgtttacggttaacggtaaaaccgttaaaaaaacgggtaacccctttaaacccccgttaaaacccccccgtttttaaaacgggtttaacggttttttttaacgggggaaccggtttttaaggggttttaaaacccgggg

SEQ ID NO: 377252 - DNA, 734 bp, Homo sapiens
  misc_feature: GZ8MTXP02JNP7I.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaagttttaaaaggtgtccagtgtgaagtgcagctggtggagtcgtgggggagcttggtacagcctggcaggtccctgagactctcctgtgcagcctctggtacttcacctttgatgtacttagtcgaccagtcgacctacggttcggggtcccgacaaacggtcccgttacccgggaaggggtaacgggcccgtaggggtacggtcggggttctaccggtagggtttatttaggttaggggtaaattaggtagggtacgtctaaaggttacggtcctaagtcgggaccggtacttcggtagggttacggaaacggggtcccgtactttacccgaaccctacgtccctaccggaagaccgaaacaaacccggaccctaaaggtaccccttcccgtagtacctacttacgaactaaaacgtcgaaaccaggtacctaggaaggtaacgcgtacgggaaacgtacccggtacggttaccgtttaggttaatttagttaacggtagaaaaccccgttaaaagacctttaaacccccgtaaaccccgttttaagttttaacggg

SEQ ID NO: 377253 - DNA, 627 bp, Homo sapiens
  misc_feature: GZ8MTXP02GEFE8.13.87.H10.1.454.CMB.2.raw
  modified_base (247)..(247): a, c, t, g, unknown or other
  modified_base (266)..(267): a, c, t, g, unknown or other
  modified_base (275)..(275): a, c, t, g, unknown or other
  modified_base (313)..(313): a, c, t, g, unknown or other
tcagtcacgtactacacgaccggtgctcgatttagcagtactgcgttgggtttgggggagaggagccccagccctgagattcccaggtgtttccattcagtgatcagcactgaacacagaggactcaccatggagttgggactgagcgtgtagttccttaggctatttaaagtgtcagtgtgaagtgcagctggtggagtctgggggagcttggtacagcctggcaggtccctgagactctcctgtncagctgtgtactctacttnntgtatatncatgcgacgtcggtcgcgacgcgtcgaggacggcgtgnggtggtcgtcgtagtagttagtagtagtagtagtagagtagtagtgtagtgtcgtacgtcgtggtaggtacgggacgtacgtactacctactactacgacgaacgaaccgaaccgaaccgaaaccgtaaccgtacccgttacgtaacgttacgtacgtaacgtaaacgtaacgaacgacgtacgtaggtacggacgacgtacggacggaccgtacggtacgttacgttagttacgttacgtacgtaacgtaaacgtaaccgtaacccttaacccgttaacgttaacgtttacggttacggttacggtttaacgg

SEQ ID NO: 377254 - DNA, 575 bp, Homo sapiens
  misc_feature: GZ8MTXP02F8QZB.13.87.H10.1.454.CMB.2.raw
  modified_base (293)..(293): a, c, t, g, unknown or other
  modified_base (361)..(361): a, c, t, g, unknown or other
  modified_base (388)..(388): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagctggtatcagacaaaaaccagggaaagtccctaagctcctgatctatgttncatccatttgacaaagtgggtcccatcaaggttcagccggcagtggatcgtgggacagaattcactcnacaatcagcagcctgcagcctgaagtntttgactaactttattactgtacaactagtactttaaataccgttacccgctacgtacggtttccgggacgggtaaggggaaccgtaaacgggttgggaaacgtaacttaaccgaaaacggtaaccgttaggtacgggtcttaacggaccctaaaccgacgttaccgtttacgtttacttaccgtac

SEQ ID NO: 377255 - DNA, 567 bp, Homo sapiens
  misc_feature: GZ8MTXP02FOJNP.13.87.H10.1.454.CMB.2.raw
  modified_base (363)..(363): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttgggtacagcctggcaggtccctgagactctcctgtgcagcctctggattcacctttgatgattatgccatgcactggggtccgcaagctccgaggggaggcctggagtggtctcgaggtattagtggaatagtggtancagtaggctatcgcgggtactcgtggtaggaaggggcccgtagttccacccatcctaccagagaaccaaacggacccaaagaacctccctagttactctagacaaactgaaacagcctagagacgcgaggacggaccacgggtccttagtatttagtaagtagaactaaaaacggtactacccgtaaaccccgttagtttaacg

SEQ ID NO: 377256 - DNA, 632 bp, Homo sapiens
  misc_feature: GZ8MTXP02HAZCH.13.87.H10.1.454.CMB.2.raw
  modified_base (264)..(264): a, c, t, g, unknown or other
  modified_base (288)..(288): a, c, t, g, unknown or other
  modified_base (306)..(306): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcttggacagcctggcaggtccctgagactctcctgtgcngcctctgattcactttgatgattngcatgcacgtgggtccgnaagctaccggaggggacggcctgggagtgggtctcgtaggttattaggtaggaattaggtggtagctagtaggtctagtcggacgtactcgtgtaggaacgggccgtattccgactactcctaccgaagacgacaaaccgaccaaacgaccctcctagtactctacgaactaaagtacgaaacgagtacccgtagaacgtaacggccgtaagggaaccgggaaccgtaaccggttccgtttaaggtttaactttaagttaaggtaactaaaccgtaaaaacggtacccttaaaccccgttaaaaccccgttttaaggttttaacgg

SEQ ID NO: 377257 - DNA, 506 bp, Homo sapiens
  misc_feature: GZ8MTXP02IDEH9.13.87.H10.1.454.CMB.2.raw
  modified_base (370)..(371): a, c, t, g, unknown or other
tcagtcacgtactacacgaccggtgctcgatttagcagtactgcgttgggtttgggagtcccagtcaggacacagcatggacatgagggtcccgctcagctcctggggctcctgctgctctggctccaggtgccagatgtgacatccagttgacccagtctccatccttcctgtctgcatctgtaggagacagagtcaccatcacttgccgggccagtcaggacattaacagttattagtctggtatcagcaaaaaccagggaaagtccctaagctcctgatctatgttgcatccatttgcaaagtgggtccatcaaggtcagccggcagtggatctgggacagaattcactctcacaatcaagcagccnncagcagagtattatactaacttattactatactaacatactaatacgtaccgtactacgtacgtacggtacggacggacgacggaggagacgacgaaacgaacgtacgtagacgtcgacacactactctctactc

SEQ ID NO: 377258 - DNA, 608 bp, Homo sapiens
  misc_feature: GZ8MTXP02JMPH3.13.87.H10.1.454.CMB.2.raw
  modified_base (402)..(402): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagtttattagtctggtatcagacaaaaaccaggggaaactccctaagctcctgatctatgttgcatcctatttgacaaaggtcgggtaccagtcaaggttcaggccggactagtgatgagggaacagtaattcactctacaacaatcagcacggctgacagctagaaatntttagactaatttatactgtaacaagtatactttaaagtacgttaccctagttacgttaacgggtttccggggaacgggtaacgggtaaacccgtaaagggggtcgggaaaatacgttaaaaccgaaaacgggtaccgttagggtcggacctaacggaccctaaaaccttacggttaccgtttcgtttccccttagtttaaccccg

SEQ ID NO: 377259 - DNA, 620 bp, Homo sapiens
  misc_feature: GZ8MTXP02JU750.13.87.H10.1.454.CMB.2.raw
  modified_base (556)..(556): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcgttggtacagccgtggcaggtccctgagactctcctgtgcagcctctggtacttcacctttgatgtattatcgccatcgccacgtcggggtcccggacaaggccgtaccggaggggacggccgtgggaggtcgggtctcgtaggttagttaggttaggaagtaggtaggtgactagtaggtctagtcggacggtactcgtaggtacggacggggtcctagttcccacctactcctaccgaagacgaaccaaaccggaccaaacggtaccctccctagtactacagaacaaagtcgaaacgcgccgtagacgtagcgtaggacggtaaacncggttacttagttattagtaagtacgaacgaaagtaccctaccctaacccgtttagtttaacgg

SEQ ID NO: 377260 - DNA, 552 bp, Homo sapiens
  misc_feature: GZ8MTXP02JRISD.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaaggcctccgaggggaaggcctgggagtgggtctcgagggtattaggtggaatggtggtagcagtaggctatggcgactcgtgtggaagggccagttcaccatcctaccgagacgaaccaacggcccaaagacctccctagtactctgacaaatcgaaacacgcctagagagctaggacggtacgacggtccttgtattagttgtagaacaaaacgtactacccgtaaacccctttagttaacg

SEQ ID NO: 377261 - DNA, 723 bp, Homo sapiens
  misc_feature: GZ8MTXP02J0WY0.13.87.H10.1.454.CMB.2.raw
  modified_base (201)..(201): a, c, t, g, unknown or other
  modified_base (520)..(521): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtncagctggtggagtcggtgggggaggtcgttggtacagccgtggcgacggtccctgagactcctcctgtcgcacgccttcgtggtacttcctaccgtttgattgtatttagtcgcctatcgacctacggtcggggtccggacgaacggcctacccgggaggggaacgggccgtgggaggttcgggtctaccgtaggttattaggttaggaagtaggtggtagcaagtaggctagtcgcggtactcgtggtaggaacggggtcctaattcccactatacccaccgaaggaacaaccgaaacggtacccaaacgtaaccccnnctacccgttacgttactacgtaacgtaacgtaaaacgtaacgaaaccgtaccgtaccgtacggtaacggacggtaccggtaacgggtaaaccgggtaacccggtaacccggttaacccggttttaacggtttaacgtttaacggtttacgttaacgtaaaccgtaaaacccgtaaacccgtttaaacccccgttaacccccg

SEQ ID NO: 377262 - DNA, 574 bp, Homo sapiens
  misc_feature: GZ8MTXP02J1UWV.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtccgcaagcctccgaggggaggcctggagtgggtctcgaggttattaggttggaatggtggtgcaagtaggctagtggcggtactcgtggtaggaacggggccgtattccacctatcctaccagacgaaccaaccgaccaaacgacctccctagtactctagacaaaatgaaacagccgtagacgacgacgtaggacggtacgaccggtccttagttaatttagtgtacgaactaaaacgtcctaccctaaaccccgtttagtttacg

SEQ ID NO: 377263 - DNA, 674 bp, Homo sapiens
  misc_feature: GZ8MTXP02IK7GV.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcttggtacagcctggcaggtccctgagactctcctgtcgcagcctctggtacttcctacctttgacttggtattatcgcctagtcgcctacggttcggggtccccggacaaacggtccgtacccgggaggggtaaccggggtcccgttaggggacggttcggggtactaccggtagggttagtttaggtaggtaagttaggtgggtacgctagtaggtccttagtcggacgtactcgtggtaggaacgggccgtacttaccgaccgtactaccgtaccaaggacgaaccaaaccggacccaaacggtaacccttcccgtagtactctagaaccaatacgaaacgacgtaccgtagaacgacgtacgaggacgggacctacggtccttaagttatttacgtaagtacgtaacaaaacgtacctaacccgttaacccgtttacgtttaacgg

SEQ ID NO: 377264 - DNA, 655 bp, Homo sapiens
  misc_feature: GZ8MTXP02JWYMT.13.87.H10.1.454.CMB.2.raw
  modified_base (360)..(360): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctctggattcacctttgatgattatgccatgcacgtggggtccgcaagctccgaggggaggcctggagtggtctcgaggtattagtggaataggnggtgcagtaggctagtggcggtactcgtggtaggaacgggggccgtaattcccgaacctacgtcctacccgaaggacgaaccaaaaccggcccaaaaggtaaacccttcccccgtaggttaacttccgtaggaccaaaagttcggaaaaccacggtaccctaggaacggaacggcgtagggaacggggaaaccgtaccgggggtaccctttagggttaaacttttaggtttaaggtacggtaaaccaaaaaggtaccttaacccccctaaaacccccggttttaggtttaaacgg

SEQ ID NO: 377265 - DNA, 610 bp, Homo sapiens
  misc_feature: GZ8MTXP02F6DKF.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctctggacttcacctttgatgattatgccatgcacgtcggggtccgcaagcctaccgaggggaacgggcctggagtggggtctcgaggtattaggtggaatggtggtgcagtaggctagtgcggactcgtgtggaaggggctagttccacgtatctaccagacgacaaaccgaccaaagtaacccttccctagtatcctagaaccgtaaatacggaaacaggacctaggaacggacgcgtagggaacggaaccgtaccgggtaccttttaggtaacttttaacgttggtacgtaaacgtaaaaacgtccttaaaccccttaaaccccgtttacggttttaaacgg

SEQ ID NO: 377266 - DNA, 752 bp, Homo sapiens
  misc_feature: GZ8MTXP02GS18N.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggatttttcctttggcttaattttaaaaggtgtccagtgtgaagtgcagctggtggagtcgtgggggagcttggtacagcctggcaggtccctgagctctcctgtgcagcctctggattccacctttgattagattatcgccatgcctacggtcggggtacccgacaaggccctaccgggaaggggaacgggccgtggggacggtcggggttactaccggtaagggtttagtttaggttagggtaaagttacgggttagggtacggcgtaaaggttacgggtccttaagtcggaccgggtaaccttcgtagggtacggaaacggggtcccgtaacgttacccacctacgtacctacccgaaagaaccgaaccgaaacccgaaccgaaaacggtaaccccttaccccgttaggttaactaccgtaacgaactaaaagtacgaaaaccgtacggaccgtaggaacgtaaggaccgtaggaaccgggtaaaccgtacccgggttacctttacggttaactttaacgttaaggtaacggaaaacctaaaaacggttacccttaaaccccgttaaaacccccgtttaaggttttaaacggg

SEQ ID NO: 377267 - DNA, 525 bp, Homo sapiens
  misc_feature: GZ8MTXP02JVA8Q.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccgagggaaatccctaagctcctgatctatgttgcatccatttgacaaaggtgggtcccatcaaggtcagccggcagtgatcgtggacagaatcactctcacaatcagcagcctgcagcctgaagtattttgactaaactttattactgtacaatagtacttaaatacgttacccgctcgtacggttcggacggagggaacctagggtcggagactaacgaaacgtactggtcggctgaccacgtactctcgttcctactaccg

SEQ ID NO: 377268 - DNA, 578 bp, Homo sapiens
  misc_feature: GZ8MTXP02GIVJK.13.87.H10.1.454.CMB.2.raw
  modified_base (192)..(192): a, c, t, g, unknown or other
  modified_base (366)..(366): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcaggacattaacagttattagtctggtatcaagacaaaaaccgagggaaactccctaagctctgatctatgttgctatcctatttgactaaaggtcgggtaccagtcaaggtcagccgcagtgatcgaggacagtatcactctcaanatcagcacgctgcagctagaagtatttgactaacttatactagtacaacgtagtacttaataccgttacccgattacgtacggtttaccgggacgggtaacgggaaccgtaaggggtacggaaagtaacgttaaacgaaaaccggtattacggggtcggtacctaacggaacctaaccgttacttccgtttacggttccctttacgtaaccg

SEQ ID NO: 377269 - DNA, 701 bp, Homo sapiens
  misc_feature: GZ8MTXP02IHW4T.13.87.H10.1.454.CMB.2.raw
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcttggacagcctggcaggtccctgagctctcctgtgcagcctctgattcacctttgatgtattatgccatcgcacgtcggggtccgcaacgcctaccgaaggggacgggccgtagggacggtggggtcctcgtaaggttagtttaggttaggaattagggttcggtagctaagttacgggacttagtggaccgtactcgttggacgggaaacggggtcccgtaatttacccgaaccgtacgttaccctacccgaaaggaaaccgaaaccgaaaacccggtaaccccgaaaaacggtaaacccccgtttccccgtttagttaacttaccctaggaaaccgtaaaattacggaaaacgacgtaccgtaggacgtaacggcgtagggaaacggtacgaaccgggttcctttaggttattagttaagtaacgaaactaaaaacggtaccttaccccgtaaaacccgtttaacgtttaagg

SEQ ID NO: 377270 - DNA, 547 bp, Homo sapiens
  misc_feature: GZ8MTXP02JUA9R.13.87.H10.1.454.CMB.2.raw
  modified_base (459)..(459): a, c, t, g, unknown or other
  modified_base (476)..(476): a, c, t, g, unknown or other
  modified_base (482)..(482): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttgggtacagcctggcaggtccctgagactctcctgtgcagcctctggattcacctttgatgattatgccatgcacgtggggtccggcaagctaccgaggggaaggcctgggagtggggtctccgagggtattagagtcggaaatggtcggtagcagtagggctagtgcgggactctgtgaacggggccattcaccatcctccagagaccacgtccaaacgaacctccctagtacnctagaccaaatcgaacngtaccngaacgagctaggacgacgacggtccttagtattaagtgtagactaaaagcctaccaaccctttag

SEQ ID NO: 377271 - DNA, 568 bp, Homo sapiens
  misc_feature: GZ8MTXP02F6UNG.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggaggcttggtacagcctggcaggtccctgagactctcctgtgcagcctctggattcacctttgatgattatgccatgcacgtgggtccgcaagcctccgaggggagggcctggagtggtctcgaggtattagtgaatagtggtgcataggctaagtgcgactcgtgtagagggccgattcaccatcctacagacacaaaccgaccaaagaacctccctagtactctacgacaaatcgaaacacggacctaggaacgacgcgtaggaacggaccgaaccggtccgtttagtatttaagtcgtaggaactaaaaacgtactaaccctaaaccccgtttacgtttaacg

SEQ ID NO: 377272 - DNA, 540 bp, Homo sapiens
  misc_feature: GZ8MTXP02G33KR.13.87.H10.1.454.CMB.2.raw
  modified_base (289)..(289): a, c, t, g, unknown or other
  modified_base (308)..(308): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcacctttgatgattangccatgcacgtgggtccgnaagctcgagggaggctggagtggtctcgaggtattagtggaataggtggtagcagtaggctagtggcggactcgtgtaggaagggccgattccacatctaccgagacgacaaacgaccaaagacctccctagtactcctagacaaatcgaaacagacctagaagagcgtaggacggacacggtccttagtattatgtagaacaaaacgactaccctaacccttagtttaacg

SEQ ID NO: 377273 - DNA, 601 bp, Homo sapiens
  misc_feature: GZ8MTXP02JG8C4.13.87.H10.1.454.CMB.2.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcgttggtacagcctggcaggtccctgagactctcctgtgcagcctctggattctacctttgatgattatgccatgcacgtgggtccgcaagctaccgaggggacggcctgggagtgggtctcgtaggtattagtaggataggtggagcagtagggctagtcggcggactgtggtaggacgggtccgtagttccaacctatcctaccgagacgaaccgaaaccgaccgaaacgtaaccctccctagtaactccgtagaccaaaattacgaaacctacgaccgtagagagacgtaggacggacgtacggtcctttaggtatttagtgtacgaacaaaagtcctaaccctaacccgttagttagtttacggagtttaggttaacg

SEQ ID NO: 377274 - DNA, 604 bp, Homo sapiens
  misc_feature: GZ8MTXP02IVPPU.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagacaaaaaccagggaaactccctaagcctcctgatctatgttgctatcctacttttgactaaaaggttcggggtacccataccgtaaggttcgaggccggctagtggatcgtagggaacagtaattcacttctacaacaatcagcagcctgcacgctagaagttatttgactaactttagttaactgtacaaacgtgtacttaacgtacgttacccgattccgtaagtttccgggacgggtaacgggaacccgtaaaggggttaggaaacggtacttaaacgaaaacggtaacgttacggtacggtactaaggaccctaacctacgttccgtcggtttacctttcttacccg

SEQ ID NO: 377275 - DNA, 704 bp, Homo sapiens
  misc_feature: GZ8MTXP02JKG47.13.87.H10.1.454.CMB.2.raw
  modified_base (261)..(261): a, c, t, g, unknown or other
  modified_base (315)..(315): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggagcttggtacagcctggcaggtccctgagactctctgngcagctctgattcactttgattgattatcgcctatcgcacgtcggggtcccganaaggcctacggaggggaacggccgtagggaggtggggtctccgtaaggttagtttaggtaggtaattaggttggtagctaagttacggggtcttaagtcgggaccggtacttcgtaggttacgggaacggggtcctacgttcccaacctatacccgtaccgaaaggaccgaaacccaaaccggaaaccgtaaaaccggtaaacccctttccccgtaagttacgtacccttagaaacctaaaagtacggaaaccaacgtaccgagaacggaaggtccgaaggtaaccgggaaccgtcgggtacctttaagttaacgtttagttcggaacgtaaaaccgtaaaaacggttaccctaaacccccgtttaaaacccgtttacgttttaaaggg

SEQ ID NO: 377276 - DNA, 666 bp, Homo sapiens
  misc_feature: GZ8MTXP02ICSUH.13.87.H10.1.454.CMB.2.raw
  modified_base (288)..(288): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggatcacctttgatgattangccatgccacgtcggggtccggactaaggcctaccggaaggggaacgggcccgtggggacgtggggtctaccgtagggttattagggttggaaagttaggtgggtagcgtaagtaggcttagttcggcggtacgtcgttggaggtaacggggccgtagttacccaccgtacttcctacccgagaacgaaccaaaccggaccaaacggtaacccttacccgtaggttactactacgaaccaaaagtacggaaacacgtccgtagaacgtacgcgtaggaaacggtaccgtacgggtaccctttaggttaactttagttaacggttacgaaacgtaaaaacgtaccgttaacccctaaaccccgttttaagtttaacggg

SEQ ID NO: 377277 - DNA, 636 bp, Homo sapiens
  misc_feature: GZ8MTXP02IXI1K.13.87.H10.1.454.CMB.2.raw
  modified_base (266)..(266): a, c, t, g, unknown or other
  modified_base (305)..(305): a, c, t, g, unknown or other
  modified_base (335)..(335): a, c, t, g, unknown or other
  modified_base (357)..(357): a, c, t, g, unknown or other
  modified_base (366)..(366): a, c, t, g, unknown or other
  modified_base (532)..(532): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtgggggagcttggtacagcctggcaggtccctgagctctcctgtgcagcctcnggattcactttgatgattatgccatgcacgtgggtccgnaagctccgagggaggcctggagtggtcttntttattatagtagtgtagtacntactccganagacctccggtgacggggcctagttccaccatcctaccgagacgactaattacccaagactacgcttacgttcttacaaattgaaaccgtacgacccgtaggaacgacggcccgaagtacggaaccgtaaccgggtacccggtttaggtaaaccgtttaaaccggnggttacggaccgggttaaaggtaacggggaaggttcccgggggtaacccccgaaaccggggttaaaaccggtttaaccctaaccggtacccgtttaaacggggg

SEQ ID NO: 377278 - DNA, 619 bp, Homo sapiens
  misc_feature: GZ8MTXP02GOEWK.13.87.H10.1.454.CMB.2.raw
  modified_base (335)..(335): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggcttggtacagcctggcaggtccctgagactctcctgtgcagcctctggattcactttgatgattatgccatgcacgtgggccggcagctccgaggggacggcctgggagtgggtcncgtaggtattaggtacggaataggtggtagcgtaagtagggctagtggcggacttcgtaggtggaaacgggcccgatttaccacacttccaccagacgaacgaaaccgccaaaagaccctacccgtagtactctagaccaaaagtacgaaaacgacgacccgtaggaagacgacgtacggaacggaccgaacgggtcctttaggtaatttaagttcgtaagactaaaaagccttacccctaaacccgtttacgttagtttttacggacggtttaggtttaaccg

SEQ ID NO: 377279 - DNA, 573 bp, Homo sapiens
  misc_feature: GZ8MTXP02ISQI1.13.87.H10.1.454.CMB.2.raw
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagcctccgaggggaggcctgggagtgggtctcgaggttattagttggaatggtggtagcagtaggctagtggcggtactcgtgtagggaaggccgtattccaccatctccagacgaacaacgaccaaacgactccctgtaactctcgacaagtacgaaacacgcctagaacgagacgtagacggtaccgacggtccttaggtaatttagttgtacactaaaagtaactaacccctaacccgttacgtatttttcggagtttaggttaacgg

SEQ ID NO: 377280 - DNA, 594 bp, Homo sapiens
  misc_feature: GZ8MTXP02IN2OT.13.87.H10.1.454.CMB.2.raw
  modified_base (365)..(365): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagcgtggattttcctttggctatttaaaaggtgtccagtgtgaagtgcagctggtggagtcgtgggggagcttggtacagcctggcaggtccctgagctctcctgtgcagcctctggacttcacctttgatgattatgccatgctacgtcggggtccggcaagcctaccgaggggaacggcctggagtgggtctcgagtattagtgatagtgngcagtaggctgtgcggactcgtggtagacgggccgtattaccacgtactctacccgaagacgaacaacggaccaaacgaaccttcccctagtacgtacctagaccaaagttgaaactagacctagaggagacgtgaacggaacgccggtaccgtttaggttatttagttaaggtacggaaactaaaaacggtaccttaaccccttaacccgtttaacggttttaaacgg

SEQ ID NO: 377281 - DNA, 566 bp, Homo sapiens
  misc_feature: GZ8MTXP02GY0DQ.13.87.H10.1.454.CMB.2.raw
  modified_base (193)..(193): a, c, t, g, unknown or other
  modified_base (372)..(372): a, c, t, g, unknown or other
  modified_base (473)..(473): a, c, t, g, unknown or other
tcagtcacgtactacacgaccggtgctcgatttagcagtactgcgttggggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggcagtcaggacattaacagttatttagctggtatcaagacaaaaaaccgagggaaacgtcccctaaagcctaccgtagaactctaatgttacgctaatccctaatttcgacgtaaaaggtcggggtacccatacgaaggttcaggccggactaggngatcgtagggaaatattcactctacacaatcagcagcctgcagctagaagtatttagactaaacttattactgtacaaactatacttaaatacgtaacccntacgtagttcggacggtacggacaagggtacgaagtaactacgaaaacgtacgtagtacggactagcaaccattctcgttactactacttccc

SEQ ID NO: 377282 - DNA, 618 bp, Homo sapiens
  misc_feature: GZ8MTXP02F2I8O.13.87.H10.1.454.CMB.2.raw
  modified_base (292)..(292): a, c, t, g, unknown or other
  modified_base (313)..(313): a, c, t, g, unknown or other
  modified_base (503)..(503): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctaattttaaaaggtgtccagtgtgaagtgcagcgtggtggagtcgtgggggagcttggtacagccgtggcaggtccctgagactctcctgtgcagcctctgattcactttgatgattangcctatgcacgtggtccgganagctacgagggacgggtctggagtggtctcgtaggtattaggtagtaactggtggtagctaagtaggctagtcgcgtactcgtggtagaacggggccattaccgaccctacgtcctaccgaagaacgaaccgaaaccggaacccaaacgtaaccctcccgtagttacttacaccgaataaagacgaaacncgaccgtagagacgtacgaggaacggtaccgtaccggtacctttaggtaactttagtaagtaacgtaacgtaaaaacgtaccttaaccccgtaaaacccgtttacgtttaaacgg

SEQ ID NO: 377283 - DNA, 608 bp, Homo sapiens
  misc_feature: GZ8MTXP02HTOA7.13.87.H10.1.454.CMB.2.raw
  modified_base (289)..(289): a, c, t, g, unknown or other
  modified_base (311)..(311): a, c, t, g, unknown or other
  modified_base (496)..(496): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggattttcctttggctattttaaaggtgtccagtgtgaagtgcagctggtggagtcgtgggggagcttggtacagcctggcaggtccctgagactctcctgtgcagcctctggattcacctttgatgattangccatgccacgtggggtcccgnaagctccgaggggaacggcctgggaggtgggtctccgaggtttattaggtaggaaattggtagggtagcaatagggcttaagtcggcgtatcgtggtaggaagggcccagttccaccctatctaccgagacgaacaaacgccaaaagacccttcccgagtaactcctagaccaaaagtcgaaacngtacccgtaggaacgagcgtaggaacggacccgtacggtacctttaggttactttagtggtacgaaaccgtaaaacgacctttacccctaaaccccgtttaagttttacggg

SEQ ID NO: 377284 - DNA, 633 bp, Homo sapiens
  misc_feature: GZ8MTXP02GKDWE.13.87.H10.1.454.CMB.2.raw
  modified_base (260)..(260): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctntggattcacctttgatgattatgcccatgcacgtgggtccggacaagctccgaaggggacggcctgggagtgggtctgagtatgtgaatgtcgtagcagtggctatggcgtactcgtggtaggaacgggccgattccactagtcctccgagagaaccaacgaccaaacgaccttccctagtatccgtagacctaaaagtcgaaacacgaccttaggaacgaagtccgtaggaacggtaccgacgggttaccgtttacggttaactttaacgttaggttaccggaataaaaaacgggtaaccttaaacccccggtaaaacccccttttacggtttaacgtttttacggggtaagtttacggggttttaaaccgg

SEQ ID NO: 377285 - DNA, 580 bp, Homo sapiens
  misc_feature: GZ8MTXP02GEG57.13.87.H10.1.454.CMB.2.raw
  modified_base (306)..(306): a, c, t, g, unknown or other
  modified_base (409)..(409): a, c, t, g, unknown or other
  modified_base (479)..(479): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctatttaaaaggtgtccagtgtgaagtgcagctggtggagtctgggggaggcttggtacagcctggcaggtccctgagactctcctgtgcagcctctggattcacctttgatgattatgccatgcacgtggtccgnagctcgaggaggctggagtggtctcgaggtatagtaggaatggtggtgcagtaggactagtgacgactcgtggtagaacgggccgaatttcaacccattaccnccgaagacgaacctaaaccggccaaaacgtaacccttccgtagtaacttctagacctaaatcggaaaacncgacgtagaacgacgacgagtacgaaccgtaccggtacgttacgttaacgttacgtggtacggaacggaggacggtacggtaccggggaaccccgtaacgg

SEQ ID NO: 377286 - DNA, 576 bp, Homo sapiens
  misc_feature: GZ8MTXP02IV7DU.13.87.H10.1.454.CMB.2.raw
  modified_base (458)..(458): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagttatttagtctggtatcagacaaaaacgagggaaatccctaagctcctgatctatgttgcatcctatttgacaaaggtcggggtacccatcaaggttcagccgacaggtggatcgtagggacagtacttcactctacaacaatcaagcagccctagcagtcctagaattagtttagactaaacttattactagtactaactagtactttaaagacgttaccccgnttacgtaggtttaccgggacgggtaacgggaaccgtaagggtacggaaagaacgttaaccgaaaacgtacgtaggtcgacgtaacgacctaacacttccgtacgttccttactacccg

SEQ ID NO: 377287 - DNA, 679 bp, Homo sapiens
  misc_feature: GZ8MTXP02F0VNV.13.87.H10.1.454.CMB.2.raw
  modified_base (319)..(319): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctaattttaaaaggtgtccagtgtagaagtgcagcgtggtggagtcgtgggggagtcttggtacagcctggcaggtcctgacgactctcctgtgcagcctctggacttcactttgatgtattatgccatcgcacggtgggtcccgganaacggtcctacccggaaggggaaccggggtccgtaggggaggttcggggtactaccgtaaggttagttaggttaggaaagttaggttggtagctaaggtagggactagtcggccggtaacttcgtaggtacggaaacggggcctaacttccaaaccgtactcgtacccgaagaaaccgacaaaacccgtaccgaaaacgtacccttacccgtagtaacctcgtaacgacaaaacgtcgaaaaccgcgtaccgtaagacggaacgtcgtagggaacggtactaccgggtactttagtagtttaagtcgtaacgaaaacgtaaaacgtcccttaaccccgtaaaacccgtttagttttaagg

SEQ ID NO: 377288 - DNA, 574 bp, Homo sapiens
  misc_feature: GZ8MTXP02ITWXN.13.87.H10.1.454.CMB.2.raw
  modified_base (499)..(499): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgcccagtgtgaggtgcagctggtggagtctggaggaggcttgatccagccgtgggggtccctgagctctcctgtgcagcctctgggttccaccgtcacgtcacacctacatgagcgtgggtcccgccaggcctcgaaggggaaggggctggagtgcgtcttcttttattatagtagtggtatacatcctccgcagacctccgtggacggggcctagttcacctatctaccagacgactaattccaaagacacgtctgtttctactaaatcaacagcctgagcgacgatacgacgacggtccgtagtacttacgngttacggcgtaggacgacggttaacgggggacccctaaacggtaaccggttacgtaccggacgttacgtacgggg

SEQ ID NO: 377289 - DNA, 564 bp, Homo sapiens
  misc_feature: GZ8MTXP02IH9XC.13.87.H10.1.454.CMB.2.raw
  modified_base (311)..(311): a, c, t, g, unknown or other
  modified_base (340)..(340): a, c, t, g, unknown or other
  modified_base (377)..(377): a, c, t, g, unknown or other
  modified_base (389)..(389): a, c, t, g, unknown or other
  modified_base (478)..(478): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggattttccttttggctattttaaaggtgtccagtgtgaagtgcagctggtggagtcgtgggggagcttggtacagcctggcaggtccctgagactctcctgtgcagcctctggattcactttgatgattatgcctatgcacgtcgggtccganaagctaccgagggaggcctggagtggtcncgtaggtattagtgataggtgtagcagtaggcttagnggcgtactgtgnggaacgggccgtattccgactactctaccgaagacgacaaaccgaccaaacgaacccttcccgtagtactctagactaaagtcgaaacncgtacctagaacgagctaggacgaaccgacgtcgtttagtattagtgtacgaactaaaacgactaccctaacccgtttagtttacg

SEQ ID NO: 377290 - DNA, 551 bp, Homo sapiens
  misc_feature: GZ8MTXP02GCHRQ.13.87.H10.1.454.CMB.2.raw
  modified_base (300)..(300): a, c, t, g, unknown or other
  modified_base (457)..(457): a, c, t, g, unknown or other
tcagtcacgtactacacgaccggtgctcgatttagcagtactgcgttgggtttgggggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtgggggaggcttggtacagcctggcaggtccctgagactctcctgtgcagcctctggattcacctttgatgattatgccatgcacgtgggtccgnaagctccgaggggaacggcctgggagtgggtctcgaggtattagtggaatgtggtagcagtaggctatggacggacttcgtggtaggaacgggccgattcaccgatctccagacgacaacgccaaacgaactccctagtactctgacaaatgaaacngacctgagagctgaggacacggtccttagtattagttgtacgactaaaacgaactaccctaacccttagtacttttcggagttacggtttaacg

SEQ ID NO: 377291 - DNA, 747 bp, Homo sapiens
  misc_feature: GZ8MTXP02HDX0C.13.87.H10.1.454.CMB.2.raw
  modified_base (285)..(285): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggcttattttaaaaggtgtccagtgtgaagtgcagctggtggagtcgtgggggagcttggtacagcctggcaggtccctgagactctcctgtcgcagcctcgtggattccacttgatgatttancgcatcgctacgtcgggtccgacacggccgtacggaggggacggtcgtagggaggtggtctacgtaggttagttaggtagtaagtaggtaggtagacgtagtaggtctagtcggtaccggtacgttcggtagggtacggggaaaccggggtaccgtaacgttacccgaaacccgtacgttacccgtaaccgaaacggaaaccgaaacccgaaacccgtaaacccgaaaaccgtaaacccttcccgttaagttaccttacgtaacgaaactaaaacgtaacgaaaccgtacgtaccgtaggaacgacgtacgtaacgggaacggtaaccggtacccgggttacgtttaaggttaaacgtttaacgttacgtaaacgtaaacctaaaaacgtaacccttaaacccccgttaaaaccccgtttacggtttaacggttttacggtaacggttttaacggtaaccgg

SEQ ID NO: 377292 - DNA, 565 bp, Homo sapiens
  misc_feature: GZ8MTXP02J02TG.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtccgcaagcctcgaggggacggcctggagtgggtctcgaggttattaggttggaataggtggtgcagtaggctagtggcggtactcgtggtaggaaggggccgtattccacatcctccgagacgacaaaccgaccaaacgacctccctagtactctgacaaatcgaacacgcctagacgacgcgtaggacggaccacggtcttagttatttagttgtacgaacaaaacgtacctacccgtaaaccccgtttagtttacg

SEQ ID NO: 377293 - DNA, 630 bp, Homo sapiens
  misc_feature: GZ8MTXP02H0B4Q.13.87.H10.1.454.CMB.2.raw
  modified_base (286)..(286): a, c, t, g, unknown or other
  modified_base (295)..(295): a, c, t, g, unknown or other
  modified_base (428)..(428): a, c, t, g, unknown or other
  modified_base (460)..(460): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtgggggagtcgttggtacagccgtggcacggtccctgagtactctctgtcgcacgtcctgtgacttctacttnatgattatncatgcagtcggtccgacacgtcacggaggggacggtcgtgggaggttcggtctagtaggttagttaggtaggtaaagttggtaggtagctaagtaggctagtgccgtatcgtaggagacgggctactccaccngttccacagacgacaaaccgaccaagtaaccnccgtagtatctagaacaaatacgaagaccgcgtagacgtacgcgtaggacggtacgtaccggttacttagttaaagtttgttacgaacgtaaaccgtaaaacgtcccttaaaccccgttaaaacccgtttaggtttacgtttttaggggacggttttaaacgtacccggg

SEQ ID NO: 377294 - DNA, 622 bp, Homo sapiens
  misc_feature: GZ8MTXP02HEMTV.13.87.H10.1.454.CMB.2.raw
  modified_base (424)..(424): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacgttgccggcagtcaggacattaacagttattagtctgtatcagacaaaaacgaggaaactcctaagctcctgatctatgttcgctatcctacgtttgactaaaggtcggggtacccagtacgtaaggttcaggtccggactaggtgatcgtgggaacagtaacttcgactacctactaacaagtcagcaagcctgcagccgtagtaagtagtttanactaaactttataccttagtaactaacgagttacttaaagtaaccgttaccctacgttacgtaacggtttccggggaacgggtaacggggtaaccgtaaacggggttacggaaagaaacgttaaacgaaaacgtaaaccggtggtacgggtactaacgggaacctaccgttaatcttacggttaccttacttaacccg

SEQ ID NO: 377295 - DNA, 539 bp, Homo sapiens
  misc_feature: GZ8MTXP02F0PT3.13.87.H10.1.454.CMB.2.raw
  modified_base (266)..(266): a, c, t, g, unknown or other
  modified_base (307)..(307): a, c, t, g, unknown or other
  modified_base (400)..(400): a, c, t, g, unknown or other
  modified_base (451)..(451): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctatttaaaaggtgtccagtgtgaagtgcagctggtggagtcgtgggggagcttggtacagcctggcaggtccctgagactctcctgtgcagcctntggattcgacctttgatgattatgccatgcacgtggtccgnaagctccgagggaggcctggagtgggtctcgaggtatagtgatagtggtgcagtaggctatggcggtactcgtgtggaagggccgattcaccntctcagacgacaaacgccaaagacctcctagtatctagacaaatcgaaacncgacgtagacgacgcgtaggacgacgacgtacgttagtaatttagtaagtacgaacaaaacgtacctaaccctaaccctttagttacg

SEQ ID NO: 377296 - DNA, 705 bp, Homo sapiens
  misc_feature: GZ8MTXP02IF2VE.13.87.H10.1.454.CMB.2.raw
  modified_base (183)..(183): a, c, t, g, unknown or other
  modified_base (292)..(292): a, c, t, g, unknown or other
  modified_base (317)..(317): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggattttcctttggctattttaaagngtccagtgtgaagtgcagctgggtggagtcgtgggggagctttggacagcctggcaggtccctgagactctcctgtgcagcctcgtggattccacctttgatgatttancgctatcgctacggtcgggtccganaacgccgtacggaggggacggccgtggggacggtcgggtctacgtaaggttattaagagttaggtaagttagggttgggtaacgactaagttacggtacttagtcgggtaccggtaacttcggtaggtaacgggaacggggtacccgtaacttaccaacccgtactacccgaaccgaagaaaccgaaacccgaaaccggtacccaaaacgttaccccttacccgttagttaacctaccgtagaaactaaacgtacgaaaccgacggtaccgtaaggaacggtacgcggtacggaacggaaccggtaccggtaccgtttacgttaagtttaacgttacgtaacgtaaacgtaaaaccgtaaccgttaacccgttaaacccgtttaaccg

SEQ ID NO: 377297 - DNA, 592 bp, Homo sapiens
  misc_feature: GZ8MTXP02HKWCG.13.87.H10.1.454.CMB.2.raw
  modified_base (302)..(302): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagtcttggtacagcctggcaggtccctgagactctcctgtgcagcctctggattcacctttgatgattatgccatgcacgtgggtccgnaagctccgagggaggcctgggagtggtctgtaggtattagtaggaacttaggtggtagactagtaggctagtcggacgggtactcgttggaggtaacggggccgtaattcccgacctaacgtcctacccgaaagacgaaccaaacgacccaaagtacctccctagtactctagactaaagtacaacagacctaggacgagcgtagacggacacgtcttagtatttagttgaacgtacaaaagtaactaccctaaacccttacgttattttacggagtttacggtttaacg

SEQ ID NO: 377298 - DNA, 689 bp, Homo sapiens
  misc_feature: GZ8MTXP02IDPBQ.13.87.H10.1.454.CMB.2.raw
  modified_base (262)..(262): a, c, t, g, unknown or other
  modified_base (286)..(286): a, c, t, g, unknown or other
  modified_base (309)..(309): a, c, t, g, unknown or other
tcagtcacgtactacacgaccggtgctcgatttagcagtactgcgttgggtttgggggggagaggagccccagtcctgagattcccaggtgtttccattcagtgatcagcactgaacacagaggactcaccatggagttgggactgagctggattttcctttggctattttaaaaggtgtccagtgtgaagtgcagctggtggagtcgtggggggagcttggtacagcctggcaggtccctgagactctcctgtgcagcctntggtattcacctttgatgatttangccatgcctacgtggggtcccgnaacgcctaccggaaggggaacgggccgtaggggaggttggggtcctacggtaagggttagtttaaggttaggggtaaaattacgggttaggggtaagtacgtaaggttaggggccttaaagttcggacccgggtacttccgttagggtacggaaacgggggcccgttaacttcccgaaccctatccctacccgaaggaacgaaccgaaacccggtacccaaaacgaacccttccccgtagttacctacgttagaacctaaagtacgaaacacgtacctaggaggacgcgaggaacgacgtacggtcttagttattagtgtacgaacaaaagtcctaaccctaacccgttacgttagttttcggagtttacggtttaaccg

SEQ ID NO: 377299 - DNA, 598 bp, Homo sapiens
  misc_feature: GZ8MTXP02I4N48.13.87.H10.1.454.CMB.2.raw
  modified_base (406)..(406): a, c, t, g, unknown or other
  modified_base (409)..(409): a, c, t, g, unknown or other
  modified_base (414)..(414): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcacctttgatgattatgccatgcagtcgggtccgcaagctccgaggggacggccgtggagtgggtctcgaggtattagtggataggtgtgctagtaggctagtgcggactcgtgtggaacggcgattccactntcncaganacaaacgccaaagaaccctcctagtactctacgaactaaagtcgaaaacgacgtacctaggaacgtacgacgttacggaacgggaccgtaaaccggggtcctttaggttaatttagttaacggtcgtaaaacgaaaaacggtcccttaaccccgttaaaacccccgtttaaggtttttaaacgg

SEQ ID NO: 377300 - DNA, 703 bp, Homo sapiens
  misc_feature: GZ8MTXP02IYD4Z.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagcgtggtggagtcggtgggggagtcttggtacagccgtggcaggtccctgacgactctcctgtgcagcctcgtggtacttccacctttgattgaatttagcgcctatcgtcctacggtcggggtcccggacaacggtccgtacccggaaggggaacgggcctagggtaggtcgggtctaccgtaggttattaggtaggaatggtgtgactagtacggctagtgacgtctcgtggtaggaacgggtcgtacgttaccgacctacgtcctaccgaagaacgaaccgaaaccgacccgtaaacgtaacccttacccgtagttacctacgtacgtactaaaacgttacgaaacgtacgtaccgtagacggtaacggacgtaacgggaaacggaccgttaaccgggttcccgtttaacgttaacgttaagtttaacggtaaacgaaccgttaaaaaacggtccttaaaacccccgtttaaccccgtttaacggtttttaaacgg

SEQ ID NO: 377301 - DNA, 532 bp, Homo sapiens
  misc_feature: GZ8MTXP02JTDTD.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagacaaaaaccgagggaaatccctaagctcctgatctatgttgcatccatttgacaaagtcgggtacccatcaaggttcagccggcaggtggatcgtgggacagaattcactctacacatcagcagcctgcagctagaagtatttgactaaactttatactagtacaaactagtacttaaatacgttacccgcttacgtacgttcgggacggtagggaacctagggtgagacgtacgaaacgtacgtcggtaggactgacacgtactctacgttctactac

SEQ ID NO: 377302 - DNA, 806 bp, Homo sapiens
  misc_feature: GZ8MTXP02F2SR0.13.87.H10.1.454.CMB.2.raw
  modified_base (297)..(297): a, c, t, g, unknown or other
  modified_base (302)..(302): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtgggggagtcttggtacagcctggcaggtccctgacgtactctcctgtgcacgcctctggacttcactttgatgattngccancgctacggtggggtcccgacaacgcctacccggaggggaacgggtcccgtaggggacggtgggttacctacggttaagggttagttagggttagggaaaagttagggttaggggttacgacgtaaaggtacggggtaccttaggttacgggaccggttaacgttcgtaggggttaacgggaaacgggggtcccttaattacccgaacccgtacttaccgaacccgaagggaaaaccaaacccgaaaacccgggtaacccaaaacggtaaccccgttcccctttaaggtaccttacccgtaaggaaacctaaaacgttaccgaaaacgaccggtaacccgtagggaaagtaaaccgggccgttaaaggggaaacccggaaacccggttaacccggggttacctttttaaggtaaaacgttttagtaacccgggttaaaacgtaaaaccgtaaaaaccgttaccccttaaacccccggtttaaaacccgtttaacggttttaacgg

SEQ ID NO: 377303 - DNA, 663 bp, Homo sapiens
  misc_feature: GZ8MTXP02JZ75J.13.87.H10.1.454.CMB.2.raw
  modified_base (260)..(260): a, c, t, g, unknown or other
  modified_base (285)..(285): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggacagcctggcacggtccctgagactctcctgtgcagcctntggtacttcgactttgatgatttancgcatcgctacggtcggtccgacacgcgaccggaaggggacggtccgtagggtcggtcggtctagtaggttagttaggtacggaagttggtacggtagacgtagtacgtctagtcggaccgtacgttcgtagggtacgggacgggtacctactaccaaccgtacttaccgaccgacgaaccgaaccgaaccgaaccgtaaacgacccttccgtagtactacgtacgaaacgtaaacgtacaacgacgtaccgaggacgacgtacgacgggaaccgtaccgaccggttcttagttaacttacggtacgaacgaaactaaaacgtcccgtaaaccccgttaaccgttacggttagtttacggtacggtttacggtaaccg

SEQ ID NO: 377304 - DNA, 572 bp, Homo sapiens
  misc_feature: GZ8MTXP02HKGXZ.13.87.H10.1.454.CMB.2.raw
  modified_base (267)..(267): a, c, t, g, unknown or other
  modified_base (371)..(371): a, c, t, g, unknown or other
  modified_base (415)..(415): a, c, t, g, unknown or other
  modified_base (447)..(447): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagcgtggtttctgtgctatttaaaggtgccagtgtgaggtgcagctggtggagtcgtggaggaggcttgatccaggccgtgggggtccctgagactctcctgtgcagcctgtggtcaccgtnagtccacacctacatgagcgtcgggtccgccaggcctaccgaggggaaggggctgggaggtgcgttctttacttttatttagtaggttagtggtagtacatacnccgcagtctccggtggacggggccagttcaccattccaccaganacaacttccaaaagacacgtcttgttacctanaaactgaacagtcctagaagcggaccagacgacgtccgggctagtattacgtggtagcgagagacgtcggggacccaacgtaacgtaacgtcgacgttagcggtaccgtcggtacggggaacccg

SEQ ID NO: 377305 - DNA, 644 bp, Homo sapiens
  misc_feature: GZ8MTXP02F758A.13.87.H10.1.454.CMB.2.raw
  modified_base (263)..(263): a, c, t, g, unknown or other
  modified_base (268)..(268): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctaattttaaaaggtgtccagtgtgaagtgcagctggtggagtcgtgggggagcttggtacagcctggcaggtccctgagactctctgtgcngcctntggattcacctttgatgattatgccatgcacgtggggtccgcaagcctaccgaggggaacgggtcctgggagtcgggtctcgtaggtattaggtgaataggtgtgcagtaggctatggcggtactcgtgtaggacgggtccgattccaccgactccgtacaacgacgacaaaccgaccaaagacccttcctagttaactcgtacgaactaaaatcgaaaacgacgaccgtaggaacggaacgtccggtaagggaacggtaacccgtaacggggttccctttaacgggttaatttaaagttgggttaaacgaaaccgttaaaaaacggtacccttaaaccccgtttaaaaccccccgtttaacggtttttaaacggg

SEQ ID NO: 377306 - DNA, 525 bp, Homo sapiens
  misc_feature: GZ8MTXP02FRAKR.13.87.H10.1.454.CMB.2.raw
  modified_base (446)..(446): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagacaaaaccagggaaatccctaagctcctgatctatgttgcatccactttgactaaagtgggtccatcaaaggttcagccgcagtggatcgtagggacagaattcaactctcaacaatcagcagctgcagcctagaagtattttgactaaactttattactagtacaactagtaccttaaatacgttaacccgnttacaagtttcggacggtagggaccaagggtggaagatacgaaaacgactagtggctaagcactatctagtcttactac

SEQ ID NO: 377307 - DNA, 551 bp, Homo sapiens
  misc_feature: GZ8MTXP02GQ3YS.13.87.H10.1.454.CMB.2.raw
  modified_base (367)..(367): a, c, t, g, unknown or other
  modified_base (418)..(418): a, c, t, g, unknown or other
  modified_base (448)..(448): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggactattaacagttattagctggtatcaagacaaaaaacgagggaaactccctaaagctacctgatctatgttgacatccatttgacaaaggtgggaccatcgaaggtcagcgcagtgatcgtaggacagattcactctacaanaatcagcagcctgcagtcctagaaagttactttgaacttaatttaattacngtaaccaatagtacttaaatacgtaccccntacgtacggttcgggacggacgggaacgtaaagggtcggaaagtactaaacgaaaacggtacgtggtcgctaacgcctaacctatcgttgtaccttctaaccg

SEQ ID NO: 377308 - DNA, 711 bp, Homo sapiens
  misc_feature: GZ8MTXP02I3BDR.13.87.H10.1.454.CMB.2.raw
  modified_base (302)..(302): a, c, t, g, unknown or other
  modified_base (327)..(327): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttaattttaaaggtgtccagtgtgaagtgcagctggtggagtcgtgggggagtcgttgggtacagtccgtgggctacgggtccctgacgtactctccgtggtgcagtccctgtggtattccactttgatgatttangccatcgacacggttcgggccgganacgcctaccggaggggaacgggtccgtgggacggttgggtctacgtaggtttaatttagggttacggtaaattaggtggtagactaagttagggcttagtcgggtaccggtattcggttaggacggggaaacggggtcccgttattacccaaccgtacttcccgacgaaacggacgaaccgaacccgaacccgaaaacgacctttacctacgttagtaactctagtaaacaaagtacgaaacgcgtacgaggacgacgtcgacgggaacgtacccggtacggttcctttaaggtactttagtacgtaacgtaaaacgtaaaacgttccctaaccccgttaaaacccgtttggttttaacggtttacggtaaggttttaaccggg

SEQ ID NO: 377309 - DNA, 623 bp, Homo sapiens
  misc_feature: GZ8MTXP02GS9IL.13.87.H10.1.454.CMB.2.raw
  modified_base (513)..(513): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctcgtggattccacctttgattgacttatgcctatgcacgtggggtccgcaagctacccgaggggaacgggtcctagggaggtgggtctaccgtagggttattaggttaggaattaggtggtaggctaagtaggctagcggcgtactgtgtggaacggtccgattccacgtactctaccgagacgaaccaaaccgccgaaaacgacccttacccgagttactacgtacgaacctaaaagtcgaaaaccncggtacccgaggaaggtaacgcggtaaggacggtaccgaacgttccgttagttatttagtaagtacgaacgtaaaacgtcctaaccccttaacccgttacgttttaacgg

SEQ ID NO: 377310 - DNA, 600 bp, Homo sapiens
  misc_feature: GZ8MTXP02JI8J2.13.87.H10.1.454.CMB.2.raw
  modified_base (271)..(271): a, c, t, g, unknown or other
  modified_base (293)..(293): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggagcttggtacagcctggcaggtccctgacgactctcctgtgcagcctntgattccactttgatgtattangccatgctacgtggggtccgcaacgcgtaccggaggggacgggccgtggaggtgggtctcgtaggttattaggttaggtaattaggtaggtagcgtaagtaggtcgtaagtggccggtactcgtgtaggacggcgtactccactctactacgaagacgaacaaccgaccaaacgtacctacccgtagtactacagaacaaagtcgaacgagtaccgtagacgacggaccggacggacgacgggtactacggttactacgttacgtgtaggacggaaggtaggtacgggttacgggggacgtaaaggg

SEQ ID NO: 377311 - DNA, 618 bp, Homo sapiens
  misc_feature: GZ8MTXP02JT90B.13.87.H10.1.454.CMB.2.raw
  modified_base (290)..(290): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctctggattcacctttgatgattangccatgcacgtcggggtcccggacaacggctaccggaggggaacgggccgtagggtaggtgggtctacgaggttatttaggtaggaataggtcggtagcagtaggctagtcggacggtactcgtggtggaacgggccgtattcccactacttccaccgaagacgaacaacggaccaaagaacccttccctagtacctacgtacgtaacaaatacgaacacgtaccgtagaacgacgaccgtaggacggtaccgaccggtaccgttagttaacttagttaaggtacaacgtaaaacgaccttaccccgtaaacccttaggttttaacgg

SEQ ID NO: 377312 - DNA, 710 bp, Homo sapiens
  misc_feature: GZ8MTXP02IZO2Z.13.87.H10.1.454.CMB.2.raw
  modified_base (255)..(255): a, c, t, g, unknown or other
  modified_base (260)..(260): a, c, t, g, unknown or other
  modified_base (280)..(280): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcngcctntggattcacttgatgattangccatgcacgtgggtccgacaagcctaccgaggggacgggctagggagtcgggtctagtaggttattaggtaggaagttaggtgggtagcaagttacgggtcttagtcggacggtactcgttggtacgggaacggggtccgtactttaccgaccctatcctacccgagaaccgaaccgtaaaccgacccgaaacgtaacccgttaccccgtagttaaacctccgtaaggaacctaaaacgtacgggggaaaccacggtacccgttaggaacgtacggacgtaacggggaacggaccggtaaccggttccgtttaaggtaacgttttacgttaagggttacaaacgtaaaaacggtaaccttaaacccccgttaaacccccgtttagtttaacggtttttaacggggtacgtttaacgggttttaaaccgg

SEQ ID NO: 377313 - DNA, 726 bp, Homo sapiens
  misc_feature: GZ8MTXP02IVLLO.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggaggcttggtacagccgtggcaggtccctgagactctcctgtgcagcctctggattcactttgatgattatgccatgcacgtgggtccgacaagcctaccgaggggaacgggtccgtagggtaggtcggggtctaccggtaggttagttaggttagggtaattaggttaggtaggctaagtagggactaggtcggacggtactcgtaggtacggaacggggtcccgtaatttacccgaccctacttacccgtacccgaaaggaccgaacccgaaaacccggaccctaaaaccggtaaaccccttccccgtaagttactacccgttagaaacctaaaagtacggaaaacacggtacccgtaggaaacggtagaccgttaaggggaaccggtaaaccgtacggggttaccctttaacggttaagtttaggttaacggttaacgaaaaccgtaaaaacggttacccgtaaaccccctttaaaacccccggttttacggttttaaaggg

SEQ ID NO: 377314 - DNA, 564 bp, Homo sapiens
  misc_feature: GZ8MTXP02HWVBF.13.87.H10.1.454.CMB.2.raw
  modified_base (294)..(294): a, c, t, g, unknown or other
  modified_base (315)..(315): a, c, t, g, unknown or other
  modified_base (369)..(369): a, c, t, g, unknown or other
  modified_base (374)..(374): a, c, t, g, unknown or other
  modified_base (421)..(421): a, c, t, g, unknown or other
  modified_base (455)..(455): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggaggtcttggtacagccgtggcaggtccctgagactctcctgtgcagcctctggattcacctttgatgattangccatgcacgtgggtccgganaacgctaccgaggggacggccgtggagtggtctcgagttagttagtggataggnggtgnagtagctagtgcgtactgtgtggagggcgtatccactatctacaganaccaacgaccaaagacctccctagtactccgtanacaactacgaacacgacgagagacgcgaggacggacgtacgttcgttagttagttacgttgtaacgaaacgtaaaacgtaccttaacccgttaaccgtttaaggtttag

SEQ ID NO: 377315 - DNA, 779 bp, Homo sapiens
  misc_feature: GZ8MTXP02IQ0EL.13.87.H10.1.454.CMB.2.raw
tcagtcacgtactacacgaccggtgctcgatttagcagtactgcgttgggtttggagagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagcgtggtggagtcgtgggggagtcttggtacagcctggcaggtccctgacgactctcctgtgcacgcctcgtggacttcctacctttgatgtaattatcgcctagtcgactacggtcggggtcccgacaaaggccctaccgggaaggggaacggggccgttaggggacgggttcgggtaccctacgtaagggttattaaggagttagggtaaaagttcgggtttagggaagtaccgtaaggtacgggtacttagtcgggacggtacttcggttaggacggaacgggggtccctaagttaccaacccgtaacgttcccaacccgaagaaacgaaaccccgaaaacgaccccgaaaagtaacccccttacccgtacggttaactacccggttaaacgaaaccgtaaaagtaaccggaaaccgtaccgtaccggtaacggaacggacggtaccggtaaacggggaaaccgggtaacccgttaacccgggtttcgtttaaagtttaacgtttaacgttaacggtaaaacggtaaaaccgtaaaaaccgttaaccccgttaacccccgtttaaaaccccg

SEQ ID NO: 377316 - DNA, 684 bp, Homo sapiens
  misc_feature: GZ8MTXP02FWX28.13.87.H10.1.454.CMB.2.raw
  modified_base (540)..(540): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggaggcttgggtacagccgtggcacggtccctgagacctctcctgtgcagcctctggattccactttgatgattatgcctatcgctacggtcggggtacccgacgaacgccgtacccggaaggggaacggggccgtggggaggtcgggtcctacgtaaggttatttaggttaggtaagttaggtagggtagcaaggtaggtctagtcggacggtactcgtggtacggaacggggcctattcccaaccgcttaccgtaccagaaaccgaccaaaccggtacccaaacgtaaccctccgtagtaacgtctacgaactaaancgaaaactcgaccgtaggaacggacgacgtacgggaacggaaccgtacggttaccgtttaaggttatttacgttaaggtacgtaaaaccgtaaaaacgttacccttaaacccccgttaaaccccgtttaaggtttttaaacggg

SEQ ID NO: 377317 - DNA, 625 bp, Homo sapiens
  misc_feature: GZ8MTXP02F8U2R.13.87.H10.1.454.CMB.2.raw
  modified_base (290)..(290): a, c, t, g, unknown or other
  modified_base (311)..(311): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctcctgtgcagcctctggattcactttgatgattangccatgcacgtgggtcccganaagcctaccggaaggggacgggtcctaggggagttggggtcacgtaggttattaggtaggaataggtgggttagcaagtagggctagtcggcggtactcgtggtaggaacgggtccgtattccgaacccacgttaccacccgaagaacgaaccaaaccgacccaaaacggtaaccccttacccgtacggttaactaccgtaacgaactaaacgtacggaaacacgtaccgagaacgacgacgtaggaacggacgacggttccttagtattagtgtagaacaaaacgtcctaaccctaacccgttagtttaacgg

SEQ ID NO: 377318 - DNA, 565 bp, Homo sapiens
  misc_feature: GZ8MTXP02GOXMP.13.87.H10.1.454.CMB.2.raw
  modified_base (247)..(247): a, c, t, g, unknown or other
  modified_base (454)..(454): a, c, t, g, unknown or other
  modified_base (466)..(466): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccggcagtcaggacattaacagttattagtctggtancagacaaaaacgagggaactccctaagctctgatctatgtgctatccatttgactaaaggtcgggtaccctatacgaaggttcagccggacgagtgatcgtaggaactagtactcactctacaacaatcaagcaacgcctagaccagtacctagtaaagttattttcgacttaaactttattactagtacaaactagtactttaaanaccgttacccgnttacgtaggtttcgggacggtaagggaccgtaagggtgaaacgaacttacgaaaacgtacgttggcgactcggactaacgtctcgtacttcttactacc

SEQ ID NO: 377319 - DNA, 590 bp, Homo sapiens
  misc_feature: GZ8MTXP02IA6KV.13.87.H10.1.454.CMB.2.raw
  modified_base (316)..(316): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggatttttccttttggcttaattttaaaaggtgtccagtgtgaagtgcagctgggtggagtcgtgggggagtcttggtacagcctggcaggtccctgagactctcctgtgcagcctctggtattctacctttgatgattatgccatgcacgtgggtccgnaagctacgaggggaggcgtggagtggtctcgaggttattagtggaataggtgtgctagtaggctagtcggcgtactcgtgaggaacgggcgtatccacactcacgagacgacaaacgaccaaacgacctcctagtactctagaacaaatacgaaacacgtactaggaacgacgcgtaggacggaacgacggttaccgttagtttaacttagttaagtaacgaaaccgtaaaaacgtacccttaaccccgttaaacccgtttaacgttttaacgg

SEQ ID NO: 377320 - DNA, 683 bp, Homo sapiens
  misc_feature: GZ8MTXP02JE2VN.13.87.H10.1.454.CMB.2.raw
  modified_base (285)..(285): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggcttattttaaaaggtgtccagtgtgaagtgcagctggtggagtcgtgggggagcttgggtacagcctggcaggtccctgagactctcctgtgcagcctctggattcacctttgatgtattancgaccatcgaccacggtcggggtcccggacaacggccgtaccggaagggggaacgggcccgtaggggtacggtcggggtctacgtaaggttaagtttaggttacggggaaattagggtaggtagctaaggttacgggcttagtcgggacggtacctggtaggtacgggaaacgggtaccgtagttacccacctactcctacccgaagaccgaaccgaaccgaccaaacgaaccttccctagtactacgtacgaacaaactagaaaccgagtaccgaggaacgagaccgtaggaacggaaccgtaccgggtaccttacggttattacgttagtacgaacaaaacgtaacgtaacccctaacccgtttacgttagttttaggtacggttaggtttaacgg

SEQ ID NO: 377321 - DNA, 787 bp, Homo sapiens
  misc_feature: GZ8MTXP02IBG30.13.87.H10.1.454.CMB.2.raw
tcagtcacgtactacacgaccggtgctcgatttagcagtactgcgttgggtttgggggagtcagtctcagtcaggacacagcatggacatgagggtccccgctcagctcctggggctcctgctactctggctccgaggtgccagatgtgacatccagatgagccagtctccactccaccctgtctgccgtctctcggagacgagggtcaccatctacgttgtcgggacaagtcaagaactagttggactaacttactttaaagttggtatacgagacaaggaacgtacgacggacaaccgacccccgtaactccgtagtactaccgtaacggtactactaccctacgtttacgacgaaccgtagggtacgggtaacctacccccgtaagttaccccggtaaacgggttaccgaagggttacgggacgttaaggtaacgtaccgtttacggtaaaggtaaaaccgttacgttaaaccctttttacccccactaacccgtaagttaccggaaccgggggtttacctaaccgacggtacccgttaaaggtaagtttacgttttacgaacctttaacgttaacctttaagttaaccgtacggaaaactttaacggtaacccgtttaccccgtacccccgttaccccgggtaccggttacccggaaaccggtacgggtaaacccgttaaggggtaacgtaaaacgtaacgtaaacggtaccggaacgttacgggtacgtaccgtacgtacccaccgtaacgtcgtacttctaccgtcctaccgtttcccacg

SEQ ID NO: 377322 - DNA, 639 bp, Homo sapiens
  misc_feature: GZ8MTXP02JQ0T8.13.87.H10.1.454.CMB.2.raw
  modified_base (310)..(310): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcacgcctctggattcacctttgatgattatgccatgcacgtgggtccgnaacgctaccgaggggaacggccgtgggacggtgggtctcgtaggtattaggtggaataggtggtagcagtaggctagtcgcggtactcgtggtaggaaacgggccgtattacccactactccgtacgagaacgaacgaaaccgaccaaaggtacctcccgtatactacgtagactaaacgtacgaaactagacccgtaggaacgacggaccgtagggaacgggtacccgaaaccgggttccgttacgttaacgtttagttggtaacgtaaacccgtaaaaacggtaccctttaacccccgttaaaacccccgtttaagtttttaacggg

SEQ ID NO: 377323 - DNA, 519 bp, Homo sapiens
  misc_feature: GZ8MTXP02FTD3P.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcaccgtcagtcacacctacatgagctgggtccgccaggctccgaggggaaggggctggagtgcgtctctttatttatagtagtggtagtacatctccgcagactccgtgaggggccgattcaccatctccagagacaattccaagaacacgctgtttctcaaatgaaacagcctgagagccgatgacacggcctgtatactgtgcgagagagtcggggcccacgaacgttactacgctagtacggg

SEQ ID NO: 377324 - DNA, 736 bp, Homo sapiens
  misc_feature: GZ8MTXP02JU1V8.13.87.H10.1.454.CMB.2.raw
  modified_base (264)..(264): a, c, t, g, unknown or other
  modified_base (284)..(284): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggcttggtacagcctggcaggtccctgagactctctgtgcagcctntggattcacttgatgattancgccatcgccacggtcgggtccgacaacggcctaccggaagggggaacgggccgtaggggaggttcgggtctacgtaggttagtttaggttaggaagttaggtggtaagcgtaagtagggtctagtcggccggtacttcgtggtacgggaacgggggtccctattacccgaccctagtccctaacgaagaaccgaaccaaaccggacccaaaacgtaaccccttcccgtagttacttcccgaagtaaccaaagttaccgaaaaccgcgtacccgtagggaacgacgtacgtaagggacccggtaaccgtaccggggttacctttagggtttaaatttacggttacggtaacgtaaaaacgtaaaaacgttcccgttaaaccccccgtttaaaaccccgtttaggggtttaacgtttttacgggggtaaacggtttacggtttaaaacccggg

SEQ ID NO: 377325 - DNA, 628 bp, Homo sapiens
  misc_feature: GZ8MTXP02GRY5Y.13.87.H10.1.454.CMB.2.raw
  modified_base (290)..(290): a, c, t, g, unknown or other
  modified_base (390)..(390): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagacaaaacagggaagtccctaagctctgatctatgttncactccactttgactaaaggtcgggtacccagtacgtaaaggttcaggccggacgagtggactcgtagggaacagtaacttcgactacctacaactaacncgacgcgacgccctagcgaacgtcctaggtaaagttacttttacgacttaaactttattaactgtaactaactagtaactttaagtaccgttacccgtcttacgtaacggtttcgggacgggtaagggggtaacctaaggggttacggaaggtaacctaaacgaaaacggggtaaccttgggtacggtacgtaaccggtaccctaacggtactttacggttcttcctttaacgtaccc

SEQ ID NO: 377326 - DNA, 625 bp, Homo sapiens
  misc_feature: GZ8MTXP02IF8ET.13.87.H10.1.454.CMB.2.raw
  modified_base (264)..(264): a, c, t, g, unknown or other
  modified_base (285)..(285): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtatttttccttttggcttattttaaaaggtgtccagtgtgaagtgcagctggtggagtcgtgggggagcttggtacagcctggcaggtccctgagactctcctgtgcagcctntggattcactttgatgattangccatgcagtcgggtccgcaagcctaccgaggggaacgggcctgggaggttgggtctcgtaggttattaggttaggaataggtggtagctaagtaggcttagtcgcggtactcgtggagaacggggcctagtccaccatctaccgagacgaacaaccgccaaacgacctccctagtactcttagacaaagtacgaacacgtcgtagagtacgcgtaggacgacgtacgttccggttattaatttagttacgtaacgaacgtaaaaacgtaacccgttaaccccttaaaccccgttttacggttaagtttttacgggaacggtttacggtttaaacccggg

SEQ ID NO: 377327 - DNA, 604 bp, Homo sapiens
  misc_feature: GZ8MTXP02HUZI5.13.87.H10.1.454.CMB.2.raw
  modified_base (285)..(285): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggcttggtacagcctggcaggtccctgagactctcctgtgcagcctctggattcacctttgatgattangccatgcacgtgggtccgcaagcctaccgagggacggcctgggaggtgggtctcgtaggtattaggtaggaattaggtggtagcgtagttagggctaagtggcggtacttcgtggtaggaaacgggccgtattccaaccgtatcctacccgagaacgaaccaaacgaccaaacgaacctccctagtactcgtagacaaactacgaaacgagcctagacgagcgtagacggacgacggtccttagtattagttgtacgaacaaaacgtaacctacccgtaaacccgtttacgtagtttttacggagtttaggtttaacgg

SEQ ID NO: 377328 - DNA, 559 bp, Homo sapiens
  misc_feature: GZ8MTXP02HXB08.13.87.H10.1.454.CMB.2.raw
  modified_base (383)..(383): a, c, t, g, unknown or other
  modified_base (482)..(482): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcactgggtccgcaagctccgaggggaaggcctgggagtgggtctccgaggtattaggttggaattaggtgtagcatagggctagtgnggactcgtgtagagggccagttcaccatctccgagacgacaacgaccaaacgtactccctagtactactcgtacaaacgtgaaacacgacctgaagacncgtggacggaccgaacggtccttagttacttatttgcgaacaaaacggtactacccgtaaacccctttacgtttaag

SEQ ID NO: 377329 - DNA, 683 bp, Homo sapiens
  misc_feature: GZ8MTXP02FW1EH.13.87.H10.1.454.CMB.2.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttcctttggctatttaaaggtgtcagtgtgaagtgcagctggtggagtcgtgggggagcttggtacagcctggcaggtccctgagactctcctgtgcagcctctggtattcacctttgatgattatgccatgcacgttcgggccggcaaggtcctaccggaagggggaacgggtccgtagggaggttcggggttcctagagggtttatttaggttagggaattagggtggtacgcgtaagtaggctaagtcggacggtacttcgttaggacggggaaacgggtcccgtatttacccacctaagttccctaacccgaagaacgtaacccgaaaccgacctaaaacgaacccttaccccgtagttaacttcgtacgaccgtaaaatacgaaaacctcgactaggagcgacgtaggacgacgtacggttcttagttactttagtacggtacgaaactaaaaccgttaaccgtaaccccgttaaacccgtttacgtttacggttttacgggtaacggtttacggtttaaccg

SEQ ID NO: 377330 - DNA, 688 bp, Homo sapiens
  misc_feature: GZ8MTXP02GYN66.13.87.H10.1.454.CMB.2.raw
  modified_base (287)..(287): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggcttggtacagcctggcaggtccctgacgactctcctgtgcagcctctggattctaccttgatgattangaccatcgctacgtcgggtccgacaacgcctaccggaggggacgggtccgtgggaggttcgggtctcgtaaggttagtttaggttaggtaaagtaggttaggtagcgtaagttacgggtcttagtcggaccggtacttcggttaggtacgggaacggggtaccctacgttacccaccctatcccgtaccgaaggaacgaaccgaaaccgacccgtaaaacgaacccttacccggttattacctacgtacgaacgtaaacgtacgaaacacgaccgtagacgacgtacgtagacggaacgtacccggttacgttacgttattacgttagtaacgaactaaaacgtaacctaacccgttaaacccgtttaggttacgttttaggacggtttaacggtttacgg

SEQ ID NO: 377331 - DNA, 590 bp, Homo sapiens
  misc_feature: GZ8MTXP02JQ14X.13.87.H10.1.454.CMB.2.raw
  modified_base (192)..(192): a, c, t, g, unknown or other
  modified_base (293)..(293): a, c, t, g, unknown or other
  modified_base (385)..(385): a, c, t, g, unknown or other
  modified_base (536)..(536): a, c, t, g, unknown or other
  modified_base (561)..(561): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcacatcacgttgccgggcagtcagactaattaacagttattagtctggtactcaagaacaaaacgagggaaactcctaagctctgatctatgtncatctagttgacgtaaggtcgggtacctagtacgtaacggtcaggccgagtaggtagtacgtcgtagggaactagtaaacttcaccttacanaactaatcgaagcacgcctacgcgacgtcgtaagtaacgtttacgtttacgaacttaaactttattacctataacctaaacgtacttaactttaaagtaccgttaccgcttacggtacggttcggacgggtaacggaacgtaggacggtanaactaacgaaacgtacgtgtacggnaacgcctaactgtcttcgtacttctaccg

SEQ ID NO: 377332 - DNA, 587 bp, Homo sapiens
  misc_feature: GZ8MTXP02JV6SK.13.87.H10.1.454.CMB.2.raw
  modified_base (404)..(404): a, c, t, g, unknown or other
  modified_base (453)..(453): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcagacaaaaaccgagggaaatccctaagctcctgatctatgttgcatcctatttgacaaaggtcgggtcccatacaaggttcaggccggcagtggatcgtagggacagaattcactctacaacaatcagcagccctgcagcctagaatagttttnactaaactttattaactgtacaatacgtacttaaagtacgttaccccgntacgtacgtttcgggacgggtaagggaacctaaggggtacggaacgtacttaaaccgaaaacggtaacttcgggttacggaccttaaggaccctaaaccgtacttccgttacggttaccctttacttaaacccg

SEQ ID NO: 377333 - DNA, 641 bp, Homo sapiens
  misc_feature: GZ8MTXP02IIRQQ.13.87.H10.1.454.CMB.2.raw
  modified_base (271)..(271): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcgttggtacagcctggcaggtccctgagactctcctgtgcagcctcnggattcactttgatgtattatcgccatgcacgtgggtccgacaacgcctaccgaggggacggccgtgggagtgggtctccgaggttattaggttggaaagtggtgtagctaagtgacttagtgacgtactcgttggaggaaagggccgtaatttcccaaccgtatcctaccgaaagacgaaaccgaaaccgacccaaaaccggaaacctttccccgtaagttaactaccgtacgaacctaaaagtcgaaacaacgcccgtaagaacggacgacgttaggaaacggtaccgaacgggttccttagttaagttagtaagttacgaaacgtaaaacgtaaccttaccccctaaacccgtttaacgtttaacgg

SEQ ID NO: 377334 - DNA, 661 bp, Homo sapiens
  misc_feature: GZ8MTXP02JGFUT.13.87.H10.1.454.CMB.2.raw
  modified_base (272)..(272): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagcgtggtggagtcgtgggggaggcgttggtacagcctggcaggtccctgagctctcctgtgcagcctnggattccacctttgatgattatgccatgcacgtgggtcccgcaaggcctacccggaggggaacggccgtggaggtggtctcgtaggtattagatggaattaggtcggtagctaagtacggcttaagtcggacggtacctgtgttagggaaacggggtccgtaagttaccaacctacgtaccctacccgaagaacgaaaccgaaaccgtacccgaaaacgtaacccttcccctaaggttacctactacggaaacctaaaagttaacgaacgtaacgacccgtagaacggagtcgaggaacggaccggtaccggtccgttaggtttaaattaagttacggttaacgaaacgtaaaacgtaaccgttaacccttaaacccccgttttaaagg

SEQ ID NO: 377335 - DNA, 656 bp, Homo sapiens
  misc_feature: GZ8MTXP02GE838.13.87.H10.1.454.CMB.2.raw
  modified_base (312)..(312): a, c, t, g, unknown or other
  modified_base (343)..(343): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggacctcaccatggagttgggactgagctggtatttttccttttggcttaattttaaaaggtgtccagtgtgaagtgcagctggtggagtcgtgggggagcttggtacagcctggcaggtccctgagactctccgtgtgcacgcctctggattcacctttgatgattatgccatcgctacgtgggtccggnaacggcctccgaaggggaacggccgtagggnggtcgggtctcgtaggttattaggtaggaacttaggtggtagctaagttagggctagcggacggtaccttgtaggtagggaaacggggtccctagttcccaaccacttaccgacccgaagaaccggaaaccaaaccggacccaaaagacccttaccctagttaactccgtagactaaaagtacaaccgagacctagacggagcgtaggaacggtaccgaaccggttcttaagttaatttacgtagtacgaaacaaaaagtccgttaacccctaaacccgttacgttagttttaggaaggtttcgtttaaacgg

SEQ ID NO: 377336 - DNA, 594 bp, Homo sapiens
  misc_feature: GZ8MTXP02FPV4I.13.87.H10.1.454.CMB.2.raw
  modified_base (490)..(490): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctaattttaaaaggtgtccagtgtgaagtgcagctggtggagtcgtgggggagcgttggtacagcctggcaggtcctgagctctcctgtgcagcctctggattcactttgatgattatgccatgcacgtggggtccgcaagcctccggagggacgggcctgggagtgggtctcgtaggtattaggtaggaataggtgtagcagtaggctagtgcggtatcgtaggtaggaaacgggccgattccaacctattcctaccgagaacgaaccaaaccggaccaaagaacctcccgtagtactctacgacaaacgtcgaaacncgaccgtaggaacgacggcccggaaaggaccgacggtctacgttaccttagttaccgtggtacgacggaaggtaacggtagggtttacgggggaacggtaaagg

SEQ ID NO: 377337 - DNA, 675 bp, Homo sapiens
  misc_feature: GZ8MTXP02GE4KB.13.87.H10.1.454.CMB.2.raw
  modified_base (287)..(287): a, c, t, g, unknown or other
  modified_base (529)..(529): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggacagcctggcaggtccctgagactctcctgtgcacgcctctggtattcactttgatgtattangccagtagaacgtggggtccgacgaagcctaccggaaggggaacggtccgtaggggtacggttgggtcttacggtaggttagttaggttaggaagttaggtaggtagacgtagtaggcttagtcggacgtactcgtgtaacgggaacgggtcctagttccaacctactaccgtacgaagaacgaacccgaaacgacccaaagtaaccccttccgtagtactcgtagaactaaagtcgaaacngaccgtagaacgtacgacgaggacgtaaccgtacgttcctttaaaggttactttacgtagtaacgaaaccgtaaaagtccctaaccccgttaaacccgtttaaggtttacgttttagggacgtttacggttaaccgttaaccgggg

SEQ ID NO: 377338 - DNA, 550 bp, Homo sapiens
  misc_feature: GZ8MTXP02FLOGI.13.87.H10.1.454.CMB.2.raw
  modified_base (337)..(337): a, c, t, g, unknown or other
  modified_base (455)..(455): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcagacaaaaaccagggaaacgtccctaagctcctagatctatgttgcatccatttgacaaagtgggtcccatcgaagttcagccgganagtgatcgtgggacagaatcactctacacaaatcaagcaacgccctgacacgtcctagaaagttactttgactaaactttattactgtacaaatagtaactttaaatacgttaccctnttacgtacggttcggacggaacgggaacgtaagggtaggaacgtaactaaacgaaacgtacgtcggacgactgacacgtactcgtctcctactac

SEQ ID NO: 377339 - DNA, 628 bp, Homo sapiens
  misc_feature: GZ8MTXP02JK0J1.13.87.H10.1.454.CMB.2.raw
  modified_base (383)..(383): a, c, t, g, unknown or other
  modified_base (397)..(397): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcttgggtacagcctggcaggtccctgagactctcctgtgcagccctctggtacttctaccttgatgattatgccatgctacgtcgggtccgacaacgctaccgaggggacggccgtggaggtggtctgaggttattagtaggtaataggtgtagcatacggctagnggtacgactgtggngaacgggtccgtattccacctatccgtacgacgaacgaccgaaacgaccgaaacgtacccttacccgtagtacttctagactaaaacgacgaaacgacgacctagacgagactaggacgaaccgtcggtacctttagtaagtttacgttagtaccgaacgtaaaacgaaccgttaaccccttaaaccccgtttaggtttacgttttagggtacgtttacggtttaaaccgg

SEQ ID NO: 377340 - DNA, 740 bp, Homo sapiens
  misc_feature: GZ8MTXP02IVR2P.13.87.H10.1.454.CMB.2.raw
  modified_base (353)..(353): a, c, t, g, unknown or other
tcagtcacgtactacacgaccggtgctcgatttagcagtactgcgttggggtttgggggggagaggagccccagccctgagattcccaggtgtttccattcagtgatcagcactgaacacagaggactcaccatggagttgggactgagctggtattttcctttggcttaattttaaaaggtgtccagtgtagaagtgcagcgtgggtggaggtcggtgggggggaggtcgttgggtacaggcccgtgggccgacgggttcccctggacgtaccttcctcctggtgccacgtccctgtggtacttcctacctttgatgtatttagtgcctatgctacggtcggggtcccgganaacgtccgtaccggaagggggaacgggccgtggggaggttcggggtctacgtaaggttagttaggttaggaaagttaggtcggtagctaagttaggctagtcggcggtacttcgtggtacgggaaacgggtcccgtaactttacccgaacctacgttccctaaccgaacgaacggaaaccaaacccggacccaaaacggtaacccttacccgtaggttactacgtacggaaactaaaagtacgaaaccacggtccgaaggaaggcgacgtagggaaccgtacgtacgggttcctttaagttatttacgttgaacgtaaaacaaaacggtccttaaaccccgtaaacccgtttagttacggttttaggacggtttacggtttaaacgg

SEQ ID NO: 377341 - DNA, 620 bp, Homo sapiens
  misc_feature: GZ8MTXP02GNV6Q.13.87.H10.1.454.CMB.2.raw
  modified_base (288)..(288): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagctctcctgtgcagcctctggattcacctttgatgattancgccatgcacgtcgggtccgcaagcctaccgaggggacgggccgtgggaggtcgggtactccgaggtataggataggaataggtggtacgcgagtacggctagtgaccggtatcgtaggtaggaacggggccgtagttaccgaccgtattaccgaccgagaacgaaccgaaaccggaccaaacgtaaccctccccgtagtactacctagaactaaacgtacgaaaccagtaccgtagaacggacgaccgaggaaccggaacgtaccggtacctttggttaattaagttacgagtaacaaaacgtaccttaccccttaaaaccccgtttaagg

SEQ ID NO: 377342 - DNA, 737 bp, Homo sapiens
  misc_feature: GZ8MTXP02JWKA8.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagtcgttggtacagccgtggccgtacgggtcccctgacgtacctcctccgtggtgcacgtcctcgtggtacttctaccgtttgattgtattatcgccagtcgctacggtggggtacccggacaacggtcctacccgggaaggggacgggtccgtaggggacggtcgggtacgttaccggtagggtttagtttagggttaggtaagttaggttagggtacgtacgaagttaagggcttaagtcgggacgtacgttcgtgggtaacggaacggggtccgtaattcccgaaacctcttaccgtacccgaaggaccgaaaccaaaccgaccgtaaaacgtaacccttcccgtagtacttacgtacggaaactaaacgtacgaaacgacgtaccgtaacggaaggtacgacgtacgggaaccgggaaacctaccgggttacctttacggttaagttacgttaaggtaacgaaactaaaacgtacccgtaaccccctttaaacccggtttacgttttaacgg

SEQ ID NO: 377343 - DNA, 737 bp, Homo sapiens
  misc_feature: GZ8MTXP02HY5N3.13.87.H10.1.454.CMB.2.raw
  modified_base (270)..(270): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggatttttcctttggcttattttaaaaggtgtccagtgtgaagtgcagctggtggagtcgtgggggagcgttgggtacagcctggcaggtccctgagctctcctgtgcagcctntggattccactttgatgattatgccatgcacggtcgggtccgcaagcctacgaggggacggccgtgggtaggtggggtctcggtaaggttatttaggtacggtaaattaggggttaggtaggtcgtaaagttggggaccttaagtcgggacggtaaccttcgtggtacgggaacgggggtcccgtaacttacccgaacctaccgttacctaccgaacggaacgaaaccgaaacccggaccctaaaacggtaaccctttaccccgtagttaacgttaccgttaggaacctaaaagtacgaaaacgtacggaccgtaggaaaaggtcggaccggtagggaaaccggaaccggtaaacccgggttccgttttacggttaacttttaaggttaaggttaccggaaaactaaaaaacgggtaccctttaaacccccggttaaacccccgtttttaacgggtttttaaacggg

SEQ ID NO: 377344 - DNA, 629 bp, Homo sapiens
  misc_feature: GZ8MTXP02I4PRI.13.87.H10.1.454.CMB.2.raw
  modified_base (261)..(261): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttccttttggcttattttaaaggtgtccagtgtgaagtgcagctggtggagtcgtgggggagcttggtacagcctggcaggtccctgagactctcctgtgcagcctntggattcacttgatgattatgccatgcacgtggtccggcaagctaccgaggggaacggcctgggagtgggtctacgaggtattaggtggaataggtgtagctagtaggctagtcggcggtacctgtaggtagaacgggtcccgtattccaccattccacccgaagacaaacaaccgaccaaacgaaacccttccctagtacttacctagaacctaaagtacgaaaacgacgacccgtagaagacgacgtaggaacggaccgacggttaccttagttaaatttacgttagtacgaaacgaaaaacgtccgtaaaccctaaaccccgtttaacgtttaacgttttacggaacggtttaggtttaaaccgg

SEQ ID NO: 377345 - DNA, 742 bp, Homo sapiens
  misc_feature: GZ8MTXP02GAON8.13.87.H10.1.454.CMB.2.raw
  modified_base (294)..(294): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgacgactctcctgtcgcagtcctcgtggtacttcctacctttgatgtatttancgccagtgcacgttcggggtcccgacaacgccgtccggaaggggaacgggccgtaggggaggtcggggttcctacgtaagggttatttagggttggtaaagttaggtaggggtaacgtcgaagttacgggcttaggtcggacggtaccttgtgggtacgggaaacggggtccgtaatttacccaaccgtacttacctacccgaacggaacaaacccgaaaaccgaccccgaaaacgtaacccttacccccgttagttaacttaccgtacgaaacctaaaagtaccgaaaaccgacggtacccgtaggaaagtacggaccgtagggaacggaccgtaccggtaccgtttagttaagttacgttagtaacggaactaaaaaccggtccttaaccccgtaaaacccccgtttacggttaagtttttagggacgttttaggtttaaacccgg

SEQ ID NO: 377346 - DNA, 522 bp, Homo sapiens
  misc_feature: GZ8MTXP02FGFAR.13.87.H10.1.454.CMB.2.raw
  modified_base (263)..(263): a, c, t, g, unknown or other
  modified_base (346)..(346): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccngggaaagtccctaagctcctgatctatgttgcatccatttgcaaagtgggtccatcaaggttcagccgcagtgatctgggacngattcactctcacaatcagcagcctgcagcctagaagtattttgactaaacttattactgtacaaacagtactttaaatacgtttacccgcttcgtaagtttcgggacgggtagggaaccaagggtggagactacgaaaacgacttggcggactggctaaccatcctgtcttctac

SEQ ID NO: 377347 - DNA, 685 bp, Homo sapiens
  misc_feature: GZ8MTXP02GXDQ4.13.87.H10.1.454.CMB.2.raw
  modified_base (306)..(306): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggaggtcttggtacagccgtggcacggtccctgacgacctctcctgtgcagcctcgtggtacttcctacctttgatgtatttancgccatgcacgtcgggtccgacacgccgtaccggaggggacgggtccgtgggtaggtcggggttctaccggtaggttagttaggttagggaattaggtggtagtcgtagtacggctagtcggacgtacttcgtaggtacggaacggggtccctaattcccgaaccgtacttcccgaacccgaaaggaccgaaacccgaaaccgtacccaaaaccggtaaccccttacccgttagttaacctaccttacgaaacctaaaagtcgaaaaccgacgtaccgtaggactaacggcgtagggaacgtaccgaccggttcttaggttaattagtaagtacgaaacgtaaaacgacccttaacccgttaaacccgtttagtttaag

SEQ ID NO: 377348 - DNA, 756 bp, Homo sapiens
  misc_feature: GZ8MTXP02GV5QT.13.87.H10.1.454.CMB.2.raw
  modified_base (621)..(621): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtcctgagctctcctgtgcagctctggacttctacctttgatgtattatcgacctatcgccgtacgtcggggtacccggacgtaacggccgtacccgggaagggggaacgggtcccggtaggggacggttcggggtcctaccggtaagggtttagtttaagggttagggtaaagttaggggttagggtacgtaccgtaaaggttacgggtaccttaagtcggggtaccgggtaccgttccggttagggtaaccgggaaacggggtcccgtaagtttacccgaacctacgtacctacccgaaaggaaccgaaacgaaacccggacccgaaaacgtaacccgttcccgtagttaactccgtaacgaacctaaagtcgaaaacncggtacccgtaggaacgacggtaccgaggaaccggtaaccgaccggttacccgtttagttaacgttacgttaaggtaacgaaaaccttaaaacggtaccctaacccccgttaaaacccgtttacggttttaacgg

SEQ ID NO: 377349 - DNA, 686 bp, Homo sapiens
  misc_feature: GZ8MTXP02HV9QE.13.87.H10.1.454.CMB.2.raw
  modified_base (228)..(228): a, c, t, g, unknown or other
  modified_base (288)..(288): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtatttttccttttggcttatttttaaaaggtgtccagtgtgaagtgcagctggtggagtcgtggggagcttggtacngcctggcagtccctgagactctcctgtgcacgcctctggtacttcactttgatgatttangccatgcgtacgtcgggtcccggacaacgcgtaccggaaggggacgggtccgtgggaggttcgggtctcgtaaggttatttaggtaggtaagttaggtaggtagtctaagtaggtcgttagtcgggtacgtacgttctcgggtaagacgggggtcccttaattcccgacctattcccaccgaagaccgaaccaaaccgacccgaaaatacccttacccttagttaaccttccgttagaaaccttaaaagcggaaaccacggaccgtaggacgagtccgtagggaaccgtcgacggtttacttagttattacgttcggaaacaactaaaacgtaaccgtaacccccttaaaccggtttaacgtttggttttaacggaacggtttttacggttaaaccgg

SEQ ID NO: 377350 - DNA, 823 bp, Homo sapiens
  misc_feature: GZ8MTXP02FXQ4T.13.87.H10.1.454.CMB.2.raw
  modified_base (251)..(251): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggagtcttggtacagcctggcacggtcccngacgactctccgtgtcgcacgcctcgtggtacttctacctttgatgtattatcgcctatcgacgtacggtcggggtaccgacgaacgtcctaccgaaggtacggggaacggtccgggtaggggtacggggttcgggttcccttaacgggtagggtttaagtttaaggggtttaggaaaagtttagggtaggggtacgacgtaaaggttacgggaacctttaggtacgggtacccggtacgtttacggtacgggtaaacggggtaaacggggtacccgttaacgtttacccgaaccccttaacgtaccccgttaacccgaaagggtaaacccgaaaacccggtaaaccccggaaaccctaaaacccggtaacccctttacccccggttaaggttaaaccttacccggtaacggttaaaccaaaaacggttaccgaaaccgaacggttacccgtaggaaacgtacggacgtacggaaccggtaaaccgtccgttaacgttgtttaaacgttaagttaaggtaaccgtaaaacgtaaaacgttacccgtaaaacccgttaacccgtttttaaagg

SEQ ID NO: 377351 - DNA, 683 bp, Homo sapiens
  misc_feature: GZ8MTXP02HR64T.13.87.H10.1.454.CMB.2.raw
  modified_base (295)..(295): a, c, t, g, unknown or other
  modified_base (315)..(315): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcgttggtacagccgtggcacggtcctgagactctcctgtgcagcctctggattctactttgatgtattangcatgctacgtcgggtccgnaacgctaccggaggggacggccgtggaggtggtcctacgtaggttagtttaggtaggtaaattggtaggtagacgtaagtaggggtccttaaggtcggcggtaccttgttgggtaggaaacggggtcctattcccaacctagttcccacccggaagaaccgaaccgaaaccgacccgaaaagtacccccttaccgttagtaacttcgaagtaacctaaaagtccgaaactacggtaccgtaggaacggtacgtacggagggaacggtaacccgttacggtcccgtttagttaacgtttacgttaaggtacgaaaacttaaaacggtcctttaaaccccccgttaaaaccgttttacggttttaaacgg

SEQ ID NO: 377352 - DNA, 555 bp, Homo sapiens
  misc_feature: GZ8MTXP02GR2CS.13.87.H10.1.454.CMB.2.raw
  modified_base (339)..(339): a, c, t, g, unknown or other
  modified_base (365)..(365): a, c, t, g, unknown or other
  modified_base (468)..(468): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcactgggtccgcaagctccgagggagggcctggagtgggtcncgtagtattagtggaatagtgggtancagtaggctagtgcggtactcgtgtaggaaggccgattcgaccatcctaccaagacgaacaaaccggaccaaacgacctccctagtaactcctagactaaaangaaacagacctgaagacgcgtagacggaacacggtccttagtatttatgtacgacaaaacgtactaccaaacccgtttacgtttaag

SEQ ID NO: 377353 - DNA, 610 bp, Homo sapiens
  misc_feature: GZ8MTXP02F9K9C.13.87.H10.1.454.CMB.2.raw
  modified_base (366)..(366): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagtttattagtctggtatcagacaaaaaccagggaaacgtccctaagctacctgatctatgttgcattccacttttgactaaaggtcggggtacccagtacgaaaggttcaggccggcagtggatcgtagggacngtaaactcactctacacaatcagcaggcctgacagcctagaaagttattttcgacttaaactttactttaacctagtacctaaatacgttaccctttaaaataaccggtttacccccgacttacggttaacgggttcgggacggggtaacgggaacgtaaagggtgggaaactacgtaaacgtaaacgtacgtacggtcgtacgtaacgacctaacgttcgtaccttacgtacctttactaccg

SEQ ID NO: 377354 - DNA, 712 bp, Homo sapiens
  misc_feature: GZ8MTXP02IZBZA.13.87.H10.1.454.CMB.2.raw
  modified_base (319)..(319): a, c, t, g, unknown or other
tcagtcacgtactacacgaccggtgctcgatttagcagtactgcgttggggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcttggtacagcctggcaggtccctgacgactctcctgtgcacgtcctcgtggtacttcctactttgattgattatcgccatcgcacggttcgggccganaagccctaccggaaggggaacgggtccgtaggggaggttcggggtcctagtaagggttagtttaggttaggtaaagttgggtaggttacgcgtaagttacgggcttaagtcggacggtacttcggtaggtacgggaacgggtcgtattaccactactcctacgaagacgaaccaacgaaccaaacgtaacctcccgtacgtactacgttacgaactaaacgtacgaaaccgacgtaccgtaggaacgacgtaccgaggaacggaaccgtaccggttaccgtttagtttaacgtttaagttacggtaaacgtaacgtaaaaacgtaaccttaaccccggttaaaaccctttaacggtttaagttttacgggtaacggtttaacggtttaaccgg

SEQ ID NO: 377355 - DNA, 669 bp, Homo sapiens
  misc_feature: GZ8MTXP02GKYLA.13.87.H10.1.454.CMB.2.raw
  modified_base (273)..(273): a, c, t, g, unknown or other
  modified_base (294)..(294): a, c, t, g, unknown or other
  modified_base (313)..(313): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaaccacagaggactcaccatggagttgggactgagctggtatttttccttttggcttaattttaaaaggtgtccagtgtgaagtgcagctggtggagtcgtgggggagcttggtacagcctggcaggtccctgagactctcctgtgcagcctntggattcactttgatgattangccatgcacgtgggtccgnaagcctaccgaggggaacgggcctgggagtggggtctaccgtagggttattaggttaggaaattaggttggtacgcaagttaggactagtcggacgggtactcgtggtacggaaacgggccgtaatttacccaacctacttaccgtacccgaaagaaccggaaaccaaacccggtaacccaaaacgtaaccccttcccgttaggtaaccttcctaagacaaaaagtcgaaaacgcggtaacccgtaggaacgaaggttccgaaggaacggaaaccgtaacggttccttaggttaatttagttaagacgtaaaacaaaacgtaccttaacccccgtaaaacccgtttagttttaagg

SEQ ID NO: 377356 - DNA, 702 bp, Homo sapiens
  misc_feature: GZ8MTXP02GE8CJ.13.87.H10.1.454.CMB.2.raw
  modified_base (260)..(260): a, c, t, g, unknown or other
  modified_base (289)..(289): a, c, t, g, unknown or other
  modified_base (576)..(576): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagcgtggtggagtcgtgggggagcttggtacagcctggcaggtcctgagctctctgngcagcctctgattcactttgatgtattangccatcgctacggttcggggtcccggacaacggccgtaccggaagggggaacgggtccgtaggggacggtcggggtactaccggtaagggttagtttagggtagggtaaattaggttggtacgcgtaagttaggaccttagtcgggtccggtaacttcgtaggtacggaaacggggtcccgtattacccgaacctacgttcccgtaccgaaaggaacgaacccgaaaccggacccaaacgtacccttacccgtagtacctcgtacgaaactaaacgtacgaaaaccncgtaccgtaggaacggtacgtcgtagggacggtaacccgtacggttaccctttaggttaactttagtaacggtaacgtaaacgtaaaacgtaccttaaccccgttaacccgtttaaggtttaacgg

SEQ ID NO: 377357 - DNA, 656 bp, Homo sapiens
  misc_feature: GZ8MTXP02GBNK8.13.87.H10.1.454.CMB.2.raw
  modified_base (204)..(204): a, c, t, g, unknown or other
  modified_base (286)..(286): a, c, t, g, unknown or other
  modified_base (306)..(306): a, c, t, g, unknown or other
  modified_base (423)..(423): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggnggagtcgtggggaggcttggtacagcctggcaggtccctgagactctcctgtgcagcctcgtggattcactttgatgattancgccatgcacgtgggtccgnaacgctccggaggggacggcctagggagtgggtctgaggttatttaggtacggtataggtcggtagctagtaggctagcggcggactcgtgtaggacgggtccattccactacttcncccgaagacgaacaaacgtaccaaaacgtacccttacccgtataacttccgtagaaccctaaaagtaccggaaacacgaccgttaggaaggaacggtcgtaaggaacggtaacccgtaaccgggttctttaaggttaatttacgtagttaacggaaactaaaaacgtccttaacccccgtaaaaccccgtttacggttagtttttacggaacggtttaggtttaaaacccggg

SEQ ID NO: 377358 - DNA, 616 bp, Homo sapiens
  misc_feature: GZ8MTXP02HTD8H.13.87.H10.1.454.CMB.2.raw
  modified_base (263)..(263): a, c, t, g, unknown or other
  modified_base (283)..(283): a, c, t, g, unknown or other
  modified_base (302)..(302): a, c, t, g, unknown or other
  modified_base (372)..(372): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctcctgtgcagcctcnggacttcacttgatgattangcatcgcagtcgggtccgnaagccgtaccgaggggaacgggtccgtgggagtgggtctgtaggttattaggtggaaagttcggtggtancgtaagtacggctaagtcggccggtacttcgtggtagggaacgggcccgtaattccgactactccgtaccgagaacgaaccgaacaaccgtaacgaacctccgtagtactctcgaactaaagtcgaacagaccgtagagaagcgtagaacggactacggttcctagtttagttacttgacgtaacgaaaactaacgtaccccgtaaaccgtttacgttagttttcggagtttacgtttaacggg

SEQ ID NO: 377359 - DNA, 604 bp, Homo sapiens
  misc_feature: GZ8MTXP02IS2LR.13.87.H10.1.454.CMB.2.raw
  modified_base (301)..(301): a, c, t, g, unknown or other
  modified_base (503)..(503): a, c, t, g, unknown or other
  modified_base (535)..(535): a, c, t, g, unknown or other
tcagtcacgtactacacgaccggtgctcgatttagcagtactgcgttggggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctgggtggagtcgtgggggaggtcttgggtacagcctgggccaggtcccctggacgaccttctccctgtgcacgcctcgtggattccactttgattgattancgccatgcctacgtcgggtccgcaacgccgtaccgaaggggaacgggccgtggggacggttcgggtactcgtaaggttagtttaggttaggtaatggtaggtagctaagttagcttagcgcggtattcgtgtagggacggacctataccacatctaccgagacgacaacgcaaagacctctagtatctgaacaatacgaacngctagacgtgacgtggacgacgtacggtcttntaattacgtgacgaacaaaacgtcctacccgtaacctttagttagtttacggtagtttacggttaacgg

SEQ ID NO: 377360 - DNA, 657 bp, Homo sapiens
  misc_feature: GZ8MTXP02FIKDM.13.87.H10.1.454.CMB.2.raw
  modified_base (383)..(383): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttgggtacaggcctggcaggtccctgagactctcctgtgcagcctcgtggacttcacctttgatgattatcgccatgcacgtggggtccgcaagctcgaggggacggcctgggagtgggttctcgaggttattaggttggaattaggtgtagctagtagggctagnggcgtactcgtggaggaacgggtccgtattaccacctagtcctaccgaagaacgaaccgaaaccgaccgaaaacgtacccgtacccgttgtaactcgttacgactaaacgtacgaaacacggccgtaggaggacgtacgtaggaacggtaccgaaccgggttccgtttagttaaacgtttattacgtacgaaccgtaaaaacgtaacccgttaaccccgttaaacccccgtttaaggttacgtttttacgggaacggtttacggtttaaaccgg

SEQ ID NO: 377361 - DNA, 671 bp, Homo sapiens
  misc_feature: GZ8MTXP02H5DUS.13.87.H10.1.454.CMB.2.raw
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctggtaggagacagacgtcacatcacttcggccggccagtcaggactattaactagttattagtcgtggtatcaagacaaaaacgagggtaaactcctaagctcctagatctatgttcgctactcctatttagacgtaaaggtcgggtacccagtacgtaaggttcaggccgtagagtggacttcgagggacagtacttactacctactacactaatccgaacgtcacgtcccgtagacccgagttaacccgttaaggtaacgtttacgtttaaccgtaccttaaaactttaacgtttacctacggtaactaacgtacggttactttaaaccggtacctttaccccgacgtttacggtacgggtttaccgggacggggaacgggtaaaccgtaaggggtacggtaaacgtacgtaaaccgaaaacgtaccgtggtacggaccgtaacgaccctaaacgtcttacggtactttccgttaacgttccccg

SEQ ID NO: 377362 - DNA, 748 bp, Homo sapiens
  misc_feature: GZ8MTXP02FUN12.13.87.H10.1.454.CMB.2.raw
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcacggtccctgacgactctcctgtcgcacgtcctcgtggtacttcacctttgatgtattatcgacctatcgctacggttcgggtccgacgaacgccgtaccggaaggggaacggccgtagggaggttcggggttcctagtagggtttaatttaggttacggtaaagttaggtaggggtagtacctaaggtacgggtcgtagtcgggacggtaccttcggtacggtaagggaaccgggtacccgtatttacccgaacctacgtacctaccgaaggaacgaaccgaaaccgaccgaaaacgaccttaccgtacgtactacgtagtaacctaaagtacgaaaccgtacgtaccgagaagacgtacgtacggaaccggtacgtaccggttaccgttacgtttaaacgtttacggttacgtaacgtaaccgtaaaaacgtaacccgttaaacccccgttaaaaccccggtttaacggtttaaggtttttaaccggtaagggtttacggtttaaaacccgggg

SEQ ID NO: 377363 - DNA, 573 bp, Homo sapiens
  misc_feature: GZ8MTXP02HDDJ3.13.87.H10.1.454.CMB.2.raw
  modified_base (288)..(288): a, c, t, g, unknown or other
  modified_base (298)..(298): a, c, t, g, unknown or other
  modified_base (303)..(303): a, c, t, g, unknown or other
  modified_base (399)..(399): a, c, t, g, unknown or other
  modified_base (403)..(403): a, c, t, g, unknown or other
  modified_base (420)..(420): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctccaggtgccagatgtgacatccagttcgacccagtctccatccttcctgtctgctatctggtaggagacagatcaccatcacgttggcccgggacagtcaggactaattaactagtttattagtctggtatcaagacaaaacgagggaaactccaagctcngatctatgtnctacnctattgacgtaaaggtcgggtaccagtcgtaaaggtcagccgcgtaggtgacgttcgagggaactagtaacttcacttcacaacgatacacgtacncgcngacgacgtatagtattnttacattacttacgtacaagtactaacgtagtacttacgtacgtacctagtcgtacgggtcggacggtaacgacgtaggacggaacgtaacgtaaacggacgtacgtcggtacgtacgaacgtactactacgttcgtccgttaacttctaccg

SEQ ID NO: 377364 - DNA, 936 bp, Homo sapiens
  misc_feature: GZ8MTXP02HLWFZ.13.87.H10.1.454.CMB.2.raw
  modified_base (321)..(321): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttaattttaaaggtgtccagtgtgaagtgcagcgtggtggaggttcggtggggggaggtcgttgggtacaggtccgttgggccgtacggtccctaggacgtaccttcctccgtggtcgccacgccttcgtggtattcctacctttgatgtattancgaccagtcgcctacggtcggggtccgacgaacgccgtaccggaagggggaacgggtccggtaggggtacgggtcgggttacctaggtaaggggtttagtttaagggttaggggtaaaagtttagggtagggttaacggtacgtaagggtttacgggtccggtttaaggttacggggtaccgggttaaccgtttcgggttagggggtaaacgggggtaaacccgggggtaccccgtttaagtttaacccccaaacccgttaaccgttaccccgttaaacccgggaaaacgggtaaaccccggaaaacccgaaaaccccgggtaaacccctaaaaaccggttaccccctttaacccccggtttaggtttaaacctaccggtttaacgaaaacgtaaaacggttacccggaaaccgttaaccgtaccggtaaggaaccggtaagtccggtaaagggaaaccccgggtaacgttacccggggtttacttttaacgttaaaggtttcggttaacggaaccttaaaaccgtaaaacgttaaccccgttaaaccccgtttaaaacccggttttacggtttaaggtttttcgggaaaacggtttttcggttaaaacccgggg

SEQ ID NO: 377365 - DNA, 676 bp, Homo sapiens
  misc_feature: GZ8MTXP02GAQ8E.13.87.H10.1.454.CMB.2.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctgtggattcaccttgatgattatgccatcgctacgtcggggtccggacaaggcctacccggaagggggaacgggccgtaggggacggttggggtcctacgtaagggttatttagggttaggtaaataggtggttaacgcaagttaggctagtcgggcgtactcgttgggtagggaacgggtccgtattaccgacctatcctaccgaaggacgaaccgaaccgtaccaaagtaccctcccgtagtactcgtcgaacaaagtacgaaaccgtgacctaggagacgcgtaggacggaccgtaccgggtcctttagttaacgttagttacggtacaaccgtaaaacggtccttaaacccccgttaaaaccccgttttacggttaacgtttttacgggacggtttacgggtttaaacccgg

SEQ ID NO: 377366 - DNA, 727 bp, Homo sapiens
  misc_feature: GZ8MTXP02I2QQE.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctaattttaaaaggtgtccagtgtgaagtgcagctgggtggagtcgtgggggagcttggtacagcctggcaggtccctgacgactctcctgtgcagcctctggtattccactttgactggtattagtgcctatcgacgtacgtcggggtcccggagaacgccgtacccggaagggggaaccgggtcccgtggggtacggtcggggtcctacggtagggttagtttaggttagggtaaattaggttagggtaggtcctaaagggttacgggactttaaggtcgggtaccgggtaccttaggtagggttacgggaaacgggggtccccgtaatttacccgaaaccctcgtccctaaccgaagaaacgaaaccaaaccggaaccctaaacggtaacccttcccgttagtaacgttcctaacgactaaaacgtacgaaaactacggacctagggaacgtaggcggtaaggacggtacctaacggtccttaaggttacttttagtcggtaacgtaactaaaacgtccttaacccccgtaaacccgtttaacgttttaacgg

SEQ ID NO: 377367 - DNA, 703 bp, Homo sapiens
  misc_feature: GZ8MTXP02IPTZ8.13.87.H10.1.454.CMB.2.raw
  modified_base (270)..(270): a, c, t, g, unknown or other
  modified_base (289)..(289): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttatttaaaggtgtccagtgtgaagtgcagctgggtggagtcggtgggggagtcttggacaggccctggctacggtccctgacgtactctcctgtgcacgcctntgattcacttgatgtatangccatcgcctacggtcgggtccgacaaggcctacggaggggaacggccgtagggaggttgggtcctagtaggttagttaggttaggaaagttggtggtacgctaaggtagccgttagcggtaccggtacttcggtggtacgggacggggtccctagttcccaacctatcccgtacgaaacggaccgaaaccgaaccgaaacccaaacgtacccttacccgttaggttaacctacgtacgtaaacctaaaagtaaccgaaacccgtagtacccgtaggaacgacgtacgtagggaccggtaaaccgtccgggttactttaggttaattagttacggaactaacctaaaacggtcccttaacccccgttaaacgttttaggttacggttttaggtaaccgtttagggtttaacccg

SEQ ID NO: 377368 - DNA, 707 bp, Homo sapiens
  misc_feature: GZ8MTXP02I92LM.13.87.H10.1.454.CMB.2.raw
  modified_base (270)..(270): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagcctggcaggtccctgagactctcctgtgcagcctntggacttcacctttgatgtattatcgcctatcgcacgtcggggtcccgcaaggcctcgaggggaggcctggagtgggtctcgaggttattaggtaggaataggtggtagcgtaagtagggtactagtcggcggtacttcgtggtacggaacggggtcccgtatttaccaacctacgtccctaccgaaaggacgaaacccaaaccggacccgtaaaacggtaaccctttacccccgtaggtttaacctaccgttacgaaacctaaaacgttacggaaaactaccggacccgttagggaacgtacggtaccggtaagggaaaccgggaaacccgtaccgggttaccttaaggtttaatttaggtttcggtaaacgaaaaccgtaaaaacggtaacctttaaccccccgtttaaaacccccgtttacggttttaaacggg

SEQ ID NO: 377369 - DNA, 927 bp, Homo sapiens
  misc_feature: GZ8MTXP02FS1X3.13.87.H10.1.454.CMB.2.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcttggtacagcctggcaggtccctgagacttctcctgtgcagcctctggattccacctttgatgtattagtcgaccagtcgacctacgtcggggtcccgactaaacgccgtaccggagggggaacggtcccggttagggaggttcggggtaccttacggtaagggtttaaacgtttaggggttaacgggtaaaacgtttaggggttacggggttaaacggtaccttaaaggttaacgggtccgtttaaaggttacggggtacccgggttaaaccgtttccggttaagggggtaagggtaaaacccgggggttccctaaacgtttacccggaaacccttacgttaccccgttaacccggaaacggaaaccggttaaacccaaaacccggtaacccggtaaaaaccgtaaaccccgtttaccccgtttacgggttaaccttaacccggttaacgtaaaacccgtaaaacggtttaaccggaaaaacccgtccggttaaccggtaacgggtaaacggttaaccccggggagtttaaaccggggaaacggggttaaaccccggttacccgggtttaccgttttaaagggttaaactttaacggttaggttaaaccgtaaaccgtaaaaaccgttaacccgttaaaccccgttaaaaccccggttttacggttaacggtttttagggaaccggtttttacggtttaaaaccggg

SEQ ID NO: 377370 - DNA, 770 bp, Homo sapiens
  misc_feature: GZ8MTXP02G67OW.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcgttggtacagcctggcacggtcctgacgactctcctgtgcagccctgtggtacttcctacctttgattgtattagtcgcctagtcgtacctaccggtcgggtacccgaacgtaaaccggtcccgtacccgggaaagggggtaacggggtccccgtaggggtaaggttcggggttacctaccggtaaggggtttaagtttaaggggttaggggtaaagttagggttagggttaacggacgttaaacggtaagggtaccgttaggtacgggtaccgggtaacgttccggtaggttacgggaaacggggtaccgtaacgtttacccaacccgtactccctaccgaacgaacgaaaccgaaaccgacccgaaacgtaacccgttccctagtactactaggaaacctaaagtacgaacgacgtaccgagaaggacgaccggtagggaaccgtaccggaccggttaccgtttaagttacgtttaagtaaggtaacgtaaaacgtaaaaacgtacctttaaacccccgtaaacccgtttagtttaaacgg

SEQ ID NO: 377371 - DNA, 591 bp, Homo sapiens
  misc_feature: GZ8MTXP02GV7FJ.13.87.H10.1.454.CMB.2.raw
  modified_base (301)..(301): a, c, t, g, unknown or other
tcagtcacgtactacacgaccggtgctcgatttagcagtactgcgttgggtttggggagtcccagtcaggacacagcatggacatgagggtccccgctcagctccgtggggctcctgctgctctggctccaggtgccagatgtgacatccagttcgacccagtctccatccttcctgtctgcatctagtaggagacagactcacatcactcgccggcagtcaggactattaactagtttattagtctggtatacacgaacaaaaacgagggaaacgtcctaagcctactgatctatgttanctatcctatttcgacgtaaaggtcggtaccatacgaagtcgagccggacaggtgacgttcgtaggaactagtacttcacttaccacaacatacacgacacgcctcggactacggtacctaggtaaacttgtttacaactaactttatacctatactaactagttaccttaagtaaccgttcctacgtacgttaggtccggtaacgggacggaacgacggttaggaagttaacgaacgaaacgtacgtcggtgtaccgaagtaacccatacgtcgtactcttacttaaccc

SEQ ID NO: 377372 - DNA, 756 bp, Homo sapiens
  misc_feature: GZ8MTXP02H493R.13.87.H10.1.454.CMB.2.raw
  modified_base (281)..(281): a, c, t, g, unknown or other
  modified_base (350)..(350): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggtattttccttttggcttaatttttaaaaggtgtccagtgtgaagtgcagcgtggtggagtcgtgggggaggtctttggtacagccgtggccgaggtccctgagtactctcctgtgcagcctntggtattcctacctttgatgtattatcgccatcgcacgtcgggtccgacaagcgtcgaggggaggtcgngggagtcgggtctaccgagttagttaggtaggaagttaggtagtgactagtagggtctagtggaccgtacgttcgtaggtaggacggggtaccgtactcccgtaaacctacttcgtaaccccgaaggtaccgaaaccaaaccggtaccccgaaaaacggtaaaccccctttcccgtaaacgggttacttaccgtaacggtaaacctaaaaacgttcggaaaacgtaccggtaaccgttacggggaagacggtacggtaaacggggttaaccgggaaacccggtaaccggggtttacccgttaaacggttttaacttaaacggttttaaggtaaaccgtaaaacggtaaaaacgttaccgttaaaaccccccgtttaaaccccggttttaaaggttttaaaccgggg

SEQ ID NO: 377373 - DNA, 728 bp, Homo sapiens
  misc_feature: GZ8MTXP02HNJC4.13.87.H10.1.454.CMB.2.raw
  modified_base (187)..(187): a, c, t, g, unknown or other
  modified_base (236)..(236): a, c, t, g, unknown or other
  modified_base (699)..(699): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaaggngtccagtgtagaagtgcagctggtggagtcgtgggggagtcttggtacngccgtggcaggtccctggagtactctcctgtcgcagcctcgtggtacttcctacgtttgattgtattatcgtacctagttcgacctacggtcggggtacccgacgaaacggcccgtaccggaagggggaacggtcccggtaggggtacggttcggggtacctacgggtaaacgggtttaagtttaagggttaggggtaaagttagggttacgggtacggacgtaaaggtaacggggtccttaagtcgggaaccggtacgttcgtaggtacgggaaacgggtccgtaattcccgaaaccgtactcccgtaaccgaaggaaccgaaccgaaaccgtaccaaaacggtacccttaccctagtactacgtacgaactaaagacgaacgacgtacgtagaacggtacgacgtaggaaccggtacgtaacggttccttaggttaacttgtaacgacgtaaacgtaaacncgttaacccctaaccgtttaggtttaacg

SEQ ID NO: 377374 - DNA, 621 bp, Homo sapiens
  misc_feature: GZ8MTXP02GQR0E.13.87.H10.1.454.CMB.2.raw
  modified_base (294)..(294): a, c, t, g, unknown or other
  modified_base (304)..(304): a, c, t, g, unknown or other
  modified_base (502)..(502): a, c, t, g, unknown or other
  modified_base (513)..(513): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggcttggtacagcctggcaggtccctgagactctcctgtgcagcctcgtggattcacttgatgattatgccatgacngtcgggccgnaacgctaccgagggacggcctgggagtggtctacgaggttagttaggtggaattcggtaggtacgcgaagtacggctaagtgaccgggacttcgtaggtagggaacgggtctacttaccgacctattccgtacccgaagaaccgaacgaaccggaccaaaggaacctacccgtagtaactcgtagacaaatcgaaacngtacctagagngagtacgacggacgacggttccttagttattacgtcgtacgaaactaaaacgtaacctaccccttaaacccgttaggttacgttttaggacgtttaacggtttaacgg

SEQ ID NO: 377375 - DNA, 720 bp, Homo sapiens
  misc_feature: GZ8MTXP02HSQHI.13.87.H10.1.454.CMB.2.raw
  modified_base (258)..(258): a, c, t, g, unknown or other
  modified_base (265)..(265): a, c, t, g, unknown or other
  modified_base (268)..(268): a, c, t, g, unknown or other
  modified_base (284)..(284): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagtcgttggtacagccgtggcaggtccctgagtctctctgtncagcctntgnttcacttgatgattancgcctagtcgctacgtcggggtccgcgaacgccgtaccggaaggggaacgggtccgtggggtaggtcgggttactacggtaggttagtttaggttaggaagttaggtggtagctaggtagggccttagtcggccggtacttcggtaggtacgggaacggggtcccgtacttacccgtaacctacgtcccgtacccgaagaacgaaacccgaaaccgacccgaaacgtaaacccttcccgttagttaccttacgtacgaactaagtacgaaaccgacgtccgtaggacgtacgtacgaacggtacggaaccgtacgggtttaccgtttagttaaacgtttagttacgtacgtaaaccgtaaaacgtaaccccttaaaccccgtaaacccgttttacggttacgtttttaggtaacggttttacggtttaaacccggg

SEQ ID NO: 377376 - DNA, 749 bp, Homo sapiens
  misc_feature: GZ8MTXP02G27MS.13.87.H10.1.454.CMB.2.raw
  modified_base (335)..(335): a, c, t, g, unknown or other
  modified_base (376)..(376): a, c, t, g, unknown or other
tcagtcacgtactacacgaccggtgctcgatttagcagtactgcgttggggtttgggggggagaggagccccagccctgagattcccaggtgtttccattcagtgatcagcactgaacacagaggactcaccatggagttgggactgagctggtattttccttttggcttaattttaaaggtgtccagtgtgagtgcagctggtggagtcgtgggggagtcttggtacagcctggcaggtccctgagactctctgtgcagcctctggattctacttgatgatatgccatgcacgtgggtaccgacaaggctaccggaggggaacggccgtagggngtcggtctagaaggttatttaggtacggaatggtacggtanacgtaagtagggcttagtcgggacccggtattcgggtagtacgggaaacggggtacccgtaacttacccgaacctacgtacccttacccgaaaggaaccggaacaaacccggaacccaaaacggtaacccttacccgttagttaaacttacgtaggaaacctaaagtacgaaaaccgtcgtacccggtaagaagggaaccgtcgggtagggtaaaccggaaccggtacccgggtttaacccttaacggtttaagtttaaaccgttttacggaaacggttaaacgaaaaaccgttcccgttaaaacccccgttaaaacccccgttttaggttaacggtttttaaccgggtaacggtttaaggtttaaaacccgg

SEQ ID NO: 377377 - DNA, 709 bp, Homo sapiens
  misc_feature: GZ8MTXP02I5Q1M.13.87.H10.1.454.CMB.2.raw
  modified_base (269)..(269): a, c, t, g, unknown or other
  modified_base (401)..(401): a, c, t, g, unknown or other
  modified_base (572)..(572): a, c, t, g, unknown or other
tcagtcacgtactacacgaccggtgctcgatttagcagtactgcgttggggtttgggggggagaggagccccagccctgagattcccaggtgtttccattcagtgattagcactgaacacagaggactcaccatggagttgggactgagctggtattttccttttggcttaattttaaaaggtgtccagtgtgaagtgcagctggtggagtcgtgggggagcttggtacagccgtggcaggtccctgagacctctcctgtcgcagcctntgacttctacttgatgtattatcgccagtgcctacgtcggggtcccgacaacggtccgtacggaaggggacggtccgtgggtacgggtggtctacgtaggttagttaggttaggaaacgttaggtagggtanacgtaagtacggacttaggtcgggacggtacttcgtaggtacggggaaacggggtccctaaagttccaacctacgtcctaccgaaagacgaacctaaaccgacccgaaaagtacccttccgtataccgtgacgtaaacaactaacggaaaccacgtccgtaaggagacggnggaacgggaacgtaaccggtaccgttacgttagtttaacttacgtacgtaacgaaaaccgtaaacgttaacccttaacccgttaaacccgtttaacggtttacgtttagggtaaacggtttacggtacggtaacggg

SEQ ID NO: 377378 - DNA, 539 bp, Homo sapiens
  misc_feature: GZ8MTXP02I293I.13.87.H10.1.454.CMB.2.raw
  modified_base (268)..(268): a, c, t, g, unknown or other
  modified_base (311)..(311): a, c, t, g, unknown or other
  modified_base (343)..(343): a, c, t, g, unknown or other
  modified_base (363)..(363): a, c, t, g, unknown or other
  modified_base (365)..(365): a, c, t, g, unknown or other
  modified_base (381)..(381): a, c, t, g, unknown or other
  modified_base (455)..(455): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctcnggattcacctttgatgattatcgccatgcacgtcgggtcccgnaagcctaccgaggggaggccgtggagtggtcncgagtattagtgaatggtgngnagtggctagtgcggtntcgtgtagaggcgatcacactctcagacgacaaacgaccaaacgacctcctagtactctagacaaatcgaaacngacgagacgacgcgtaggacgacgtacgtcttagtattagtgtaacgaactaaaacgtacctaaccctaaccgtttacgttaag

SEQ ID NO: 377379 - DNA, 649 bp, Homo sapiens
  misc_feature: GZ8MTXP02GV9UI.13.87.H10.1.454.CMB.2.raw
  modified_base (313)..(313): a, c, t, g, unknown or other
  modified_base (379)..(379): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggtacttcacctttgattgattatgccatgctcgtgggtcccganaagcctcccgaggggacgggcctaggaggtgggtctcgaggtattagagtaggaattaggtggtancagtaggctaagtcgggacggactcgtaggtgaaacggggtcccattaccgacctattcccaccgagaacgaaaccgaaaccgacccgaaaacgtaacccttccccgtaggttaactaccgttagacctaaaaagtcgaaaccgtaacggccctaggaacgacgaccggtaggaacggaaccgttacgggtaccctttaggttaacgttaagtttgggaacgtaaacccaaaaaggttacccttacccccgtaaaaccccgtttttaagg

SEQ ID NO: 377380 - DNA, 602 bp, Homo sapiens
  misc_feature: GZ8MTXP02F2JJ3.13.87.H10.1.454.CMB.2.raw
  modified_base (294)..(294): a, c, t, g, unknown or other
  modified_base (373)..(373): a, c, t, g, unknown or other
  modified_base (498)..(498): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctaattttaaaaggtgtccagtgtagaagtgcagcgtggtggagtcgtgggggagtcgttggtacagcctggcaggtccctgagactctcctgtgcagcctctggattcaccttgatgattangacctatcgacacgtcgggtccgacaagccgtaccgaggggacggcctggaggtggtctacgagttagtagtgaatagngtagcagtagctagtgacgtactcgtgtaggaacggcgtattcaaccgtctcgtaccgagaacgaaccaaccgaccaaaacgaacccttcccgtagtaactccgtacgaacaaacgtacgaaacncgaccgtagacgtacgccgtaggacgacgacggttaccttagttacgttagtaagtacgtaaacgaaaacgtacctaccccgtaaacccgtttagtttaaacgg

SEQ ID NO: 377381 - DNA, 672 bp, Homo sapiens
  misc_feature: GZ8MTXP02GIQDB.13.87.H10.1.454.CMB.2.raw
  modified_base (264)..(264): a, c, t, g, unknown or other
  modified_base (269)..(269): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctcctgtgcngcctntggattctacctttgatgattatcgccatcgcacgtcggggtacccgcaacgccgtaccggaaggggacggtccgtggggacggtcgggtacctacggaggttagtttaggttaggtaaagttaggttgggtagcgtaagtacgggtctagtcggacggtacttcgtaggtacggaacggggcctaattcccaaccgtactccgtaccgaagaacgaacccgaaaccggacccgtaaaacgtacccttacccgttagtaacctcgtacgaaactaaacgtacggaaacctgtacccgtagaacggtacgtcgtagggaacgtaccgtacggtacctttagtaactttacgtaaggtactaacgtaaaaacgtccttaacccccgtaaccgtttagtttaacgg

SEQ ID NO: 377382 - DNA, 738 bp, Homo sapiens
  misc_feature: GZ8MTXP02I644K.13.87.H10.1.454.CMB.2.raw
  modified_base (263)..(263): a, c, t, g, unknown or other
  modified_base (297)..(297): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctaattttaaaggtgtccagtgtgaagtgcagctggtggagtcgtgggggagtcttggtacagcctggccaggtcctgagtactctcctgtncagtcctctggtattccactttgattgtattacncgacctatcgacacggttcggggtcccgagtaacgcgtacccggaggggacggccgtagggagtcgggtctacggtaggttagtttaggtagggtaattacggggtagttcggcgtaagttaacggccttaagtcgggacggtaccttcggtggtacggggaacggtaccgtacgtaccctacctcttaccgtccgaaggaacgaaccaaaccgggaccctaaaacggtaaccccttcccgttaacttacgttaccgtaacgtaacctaaaacgtacggtaaaaccgtcgggtacctaagggaacggtaacggccgttaaacggaaccggggtaaacccgtacggggttaccctttaaggttacgtttaaaggttcggtaaacggtaaacctaaaaacgttcccgttaacccccttaaaacccggtttaaggttttaacgg

SEQ ID NO: 377383 - DNA, 721 bp, Homo sapiens
  misc_feature: GZ8MTXP02GYGFT.13.87.H10.1.454.CMB.2.raw
  modified_base (193)..(193): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctggtagganacagagtcaccatcacttgccgggcagtcaggactattaacagtttattagtctaggtatcagaacaaaacgagggaaactccctaagctctgactctatgttgctactcctatttgactaaaagggtcgggtaccacgtacgtaagggttcaacggcccggtacgtaggtacgggaacgttccggtaggggaacctaggtaactttccgaaaccttcctaccaactaaactaccaacggcaaccgtccgtacgacccgtaacgtccgtaaggttaaattacgttttacgaaccctttaatttaacgttactacggtaaccgtaaaccgtactttaaccgtttaaaacgttaccggttaaaccccgttcttaacgggttaaccgggttttaccggggaaccggggtaacggggtaaaccgggtaaaagggttcgggaaagtaaccgttaaacggaaaaccgttaacgtgggtacgtaacggtccgaccaaaccggtttacgttacgttcgtttaccttaccgttaccg

SEQ ID NO: 377384 - DNA, 766 bp, Homo sapiens
  misc_feature: GZ8MTXP02GGB3H.13.87.H10.1.454.CMB.2.raw
tcagtcacgtactacacgaccggtgctcgatttagcagtactgcgttgggtttggggggagaggagccccagccctgagattcccaggtgtttccattcagtgatcagcactgaacacagagactcaccatggagttgggactgagctggtattttcctttggctattttaaaaggtgtccagtgtgaagtgcagctggtggagtcgtgggggagcttggtacagcctggcaggtccctgagactctcctgtgcagcctcgtggattcactttgatgattatgccagtcgcacgtcgggtccgacaagcctaccgaaggggaacgggcctagggaggtggggttcctacgtaaggttaagtttaggttagggtaaagttaggtacgggttaagacgtaagttaagggtccgttaatcgggacgggtaaccttgtgggtaacgggaacggggtcccgtaagtttacccaacctaactccctacccgaagacgaaccaaaaccggacccaaaacgtaacccttaccccgtagtaactaccgttagaacctaaaaagtacgaaaaccgtagtacctaggaaacgaaggccgtaaggaacgggaaaccgtaccggggttaacccttttagggtttaaacttttaaacgtttacggttaaacggaaacctaaaaaaaacggtaacccgttaaaacccccttaaaacccccgttttaaacggtttaaacggttttttaacggggtaaacggttttacgggtttaaaacccgg

SEQ ID NO: 377385 - DNA, 677 bp, Homo sapiens
  misc_feature: GZ8MTXP02JMRRN.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaggtgtccagtgtgaagtgcagctggtggagtcgtgggggagtcttggtacagccgtggcaggtccctgagacctctcctgtcgcagcctcgtggtacttccacctttgattgtatttagtcgacctagttcggcctaccggttcggggtacccgactaaggcccgtacccggggaaggggtacgggtcccgtggggacggttcggggtactccggtaaggttagtttaacggttggtaaagttacgggttagggtacgactaaggttaggacctagtggaccgtcgtcgtaggtaggacgggacgacttaccgacctatccgtaccgacgaacgaaccgaaaccgaccaaacggtaccttaccccgtagtactacgtacgaaccaaagtacgaaacgacgtcgagagtagacgaggacgacgtaccggttcttacgtagtttatcgtacgtaaacgtaaaacgtacctaacccttaacccgttacgtttaaacg

SEQ ID NO: 377386 - DNA, 579 bp, Homo sapiens
  misc_feature: GZ8MTXP02FXP56.13.87.H10.1.454.CMB.2.raw
  modified_base (361)..(361): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagctggtatcagacaaaaaccgagggaaactccctaagcctctagatctatgttgctatcctactttgactaaaggtcgggtacccagtcaaggttcagtccgacagtgatcgtaggaacngaatcactctacaacatcagcagcctagcagtccagaagtatttgactaactttataccgtagttaccaaatacgttaactttaaagtacgttaccccagttaccgtaggtttccgggacggtacgggaaccgaaagggttcggaaagtactaaacgaaaacggtacgtaggtacgctaacgacctaactacgttccgtacgttaccttacgtaaccc

SEQ ID NO: 377387 - DNA, 558 bp, Homo sapiens
  misc_feature: GZ8MTXP02F82XK.13.87.H10.1.454.CMB.2.raw
  modified_base (314)..(314): a, c, t, g, unknown or other
  modified_base (363)..(363): a, c, t, g, unknown or other
  modified_base (375)..(375): a, c, t, g, unknown or other
  modified_base (398)..(398): a, c, t, g, unknown or other
  modified_base (401)..(401): a, c, t, g, unknown or other
  modified_base (478)..(478): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccctgagactctcctgtgcagcctctggattcacctttgatgattatcgaccatgcacgtgggccganaacgctaccgagggaggcctggagtggtctgagtagtagtgaatagtgngcagtagctagngcggactgtgagacggcatcacntcncgagacgaacacgacaaagtacctacctgtaacttcaacgtaacgaaaatcggaaacacgaccgtagacgacggtcngggaacgtaccggacggttccttagtaattagtgtacgaaactaaaacgtaccttaaccctaaaccgttacgttttaagg

SEQ ID NO: 377388 - DNA, 563 bp, Homo sapiens
  misc_feature: GZ8MTXP02FUBNI.13.87.H10.1.454.CMB.2.raw
  modified_base (419)..(419): a, c, t, g, unknown or other
  modified_base (474)..(474): a, c, t, g, unknown or other
  modified_base (525)..(525): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtccggcaaggcctaccgaggggagggcctgggagtcggggtctccgaggttataggttggaataggtggtgcagtaggctagtggcggactgtgtaggaggccattccacatcnccagacgacaacgccaaagtacctcccgtagtactctacgactaaagtcgaaacncgtaccgtagagacgcgtaggacggtacacggtcttagtatttagtggtanaacgtaaaacgtctaaccctaacccgtttagtttaacg

SEQ ID NO: 377389 - DNA, 714 bp, Homo sapiens
  misc_feature: GZ8MTXP02IUT6P.13.87.H10.1.454.CMB.2.raw
  modified_base (292)..(292): a, c, t, g, unknown or other
  modified_base (620)..(620): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggtattttcctttggcttaattttaaaggtgtccagtgtgaagtgcagctggtggagtcgtgggggagcttggacagcctggcaggtcctgacgactctcctgtgcagcctcgtggacttctactttgatgattntcgcctagtcgctacggtcggggtacccgactaaacgccgtacccgggaagggggtaacgggtcccggttggggtacggttcggggtccttaccggtaaggggtttaatttagggttagggtaaagtttaggggttagggtacggtacgttaaggtacgggtaccttaggtcgggaccgggtacttccgggttaggtacggtaaacggggtcccgtaattacccgaactaccgttaccgtacccgaaaggaaccgaaccgaaaccggaaccctaaaacgtaaacccgttccctaggttacctaccgtagaactaaagtacaaaaccgngacctagacgtaacgcgtaggacgaccgtacggtcttagtatttacgtgtacgaacgtaaaacgtccttaacccttaacccgtttagtttacgg

SEQ ID NO: 377390 - DNA, 595 bp, Homo sapiens
  misc_feature: GZ8MTXP02FJP9G.13.87.H10.1.454.CMB.2.raw
  modified_base (190)..(190): a, c, t, g, unknown or other
  modified_base (302)..(302): a, c, t, g, unknown or other
  modified_base (389)..(389): a, c, t, g, unknown or other
  modified_base (477)..(477): a, c, t, g, unknown or other
tcagtcacgtactacacgaccggtgctcgattagcagtactgcgttgggtttggggagctctgggagaggagccccagccctgagattcccaggtgtttccattcagtgatcagcactgaacacagaggactcaccatggagttgggactgagctggtatttcctttggctatttaaaaggtgtccagtntgaagtgcagctggtggagtcgtgggggagtcttggtacagccgtgggcacggtcccctggacgaccttcctcctggtcgcacgcctcgtggattccacctttgatgtattntcgccatgcacggtcgggtccgcaagcctccggaggggacgggtcctgggagtcgggtctcgtagggttataggttgaatgtgggtncagtggctatggcgtactcgtggtaggaaacggtccgtattcccacctatccaccgagaccgaccaccgtaccaaacgaccctccgtntactcacgacaaatgaaccagtccgagacgacgctaggaaccgacgaacccggtcttagtaactttagtcgtacgaacctaaaacgccgtaacccctaaacccgttacggtttaacgg

SEQ ID NO: 377391 - DNA, 782 bp, Homo sapiens
  misc_feature: GZ8MTXP02IE62X.13.87.H10.1.454.CMB.2.raw
  modified_base (281)..(281): a, c, t, g, unknown or other
  modified_base (287)..(287): a, c, t, g, unknown or other
  modified_base (308)..(308): a, c, t, g, unknown or other
  modified_base (315)..(315): a, c, t, g, unknown or other
tcagtcacgtactacacgaccggtgctcgatttagcagtactgcgttgggtttggggagctctgggagaggagcccccagcccctgagattcccaggtgtttccattcagtgatcagcactgaacacagaggactcaccatggagttgggactgagctggtattttcctttggcttaattttaaaaggtgtccagtgtgaagtgcagctgggtggagtcgtgggggagcgtttgggtacagccgttggcgtaagggtcccctgagacctctccgtgtgacncgcctnaggattccaacctttgagttnaatttancgactgtcgacgtcggtcgggaccgagaacgccgtacgggaagggacggcggtagggtaggtcggtactacgtaggttagttaggtaggtaattaggtagtagtacgacgtaaggtacggtacttagtcggtaccggtacttcggtagggtaacggacggtaccgttaacgtaccctaaccgtacgtacccgaacgaaacgaaaccgaaacccgtaaaccggtaaaccctaaaccgttaacccttacccgttaagtttaaccgtaccgtaaagtaaacgtaaaacgtaaacgtaaaccgtaaccgtaccgtaacggtaacggtacggtacggtaacggtaaaccgggtaaaccggtaaccggttaccggttttaacgtttaacgtttaacggtttaacggttaacggtaaaaccggtaaaaccgttaaaccccgtttaaaccccgtttaaaccccggtttaaaccgg

SEQ ID NO: 377392 - DNA, 582 bp, Homo sapiens
  misc_feature: GZ8MTXP02IWFRH.13.87.H10.1.454.CMB.2.raw
  modified_base (369)..(369): a, c, t, g, unknown or other
  modified_base (375)..(375): a, c, t, g, unknown or other
  modified_base (399)..(400): a, c, t, g, unknown or other
  modified_base (407)..(407): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctatttaaaggtgcccagtgtgaggtgcagctggtggagtctggaggaggcttgatccagccgtgggggtccctgagactctcctgtgcagcctctggttcaccgtcagtcacacctacatgagctgggtccgccgaggctcccgaggggaacggggctagggagtgtccgtcttcttttattatagtatggtagtacntactcncagactccgtgaggggcagtcacnnctcaganacaatcaaagacagtccttgttctactaaatcgaacagaccctagacgagaccgagtacgacgaccggtccgtagttacgttaccgtggtacgcggtaacgacggttaaggtccgggggacccccgtaaacggtaaaccgtttaaccgtaaccggactttaaaccggttacgggg

SEQ ID NO: 377393 - DNA, 680 bp, Homo sapiens
  misc_feature: GZ8MTXP02FORES.13.87.H10.1.454.CMB.2.raw
  modified_base (265)..(265): a, c, t, g, unknown or other
  modified_base (284)..(284): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctctggnttcacctttgatgtattangccatgcacgtgggtccgacaagcctaccgaggggaacggccgtagggaggtcggggtctacgaggtaatttggttaggtaaagttaggtgggtaagcgtaaagtacgggtctagtcggcggtactcgtgggtagaaacggggccgtattaccacccgatcctacagacgaacaaccggaccaagtaacctccgtatacttcacgacctaaaatcgaaaaccgcgacccgtaggaagaggacgtaggaaccggaaccggtaccggtacccgtttaggtaagtttaacgtttacgtaaagtaaccgttaaaaacggaacccgtttaaaccccttaaacccccgtttaaacggtttacgttttacggggttaaaaccgtttagggttttaaaacccgg

SEQ ID NO: 377394 - DNA, 582 bp, Homo sapiens
  misc_feature: GZ8MTXP02JWA3S.13.87.H10.1.454.CMB.2.raw
  modified_base (291)..(291): a, c, t, g, unknown or other
  modified_base (381)..(381): a, c, t, g, unknown or other
  modified_base (399)..(399): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcagacaaaaacgagggaaactcccaagcctacgtagaacttntagtgtacactatacctattgaacgtaaaggtcggtaccatacgtaagtacacgccgagagtgatgtaggacagtactacactacacaanaactacacgacgacgacncgacgacgactagtaagtagttactactaacttaattacttacgtaactaactaacgtaacttaattaacgttaaccgtactacgtacgttacggtacgggacggaacggtaacggtaggagaacgtaacgaaacgtaacgtacgtacgtacgtaacgacacactacgtacgttactactacg

SEQ ID NO: 377395 - DNA, 675 bp, Homo sapiens
  misc_feature: GZ8MTXP02G2UFY.13.87.H10.1.454.CMB.2.raw
  modified_base (263)..(263): a, c, t, g, unknown or other
  modified_base (273)..(273): a, c, t, g, unknown or other
  modified_base (289)..(289): a, c, t, g, unknown or other
  modified_base (310)..(310): a, c, t, g, unknown or other
  modified_base (348)..(348): a, c, t, g, unknown or other
  modified_base (383)..(383): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagagactcaccatggagttgggactgagctggtatttttcctttggcttaattttaaaaggtgtccagtgtgaagtgcagctggtggagtcgtgggggagtcttggtacagcctggcaggtccctgagctctcctgtncagcctgtgnttcactttgatgtatntcgccatgcacgtgggtccgnaagcctaccggaaggggacggcctagggagtcgggtcncgtaggttatttaggtcggaagttaggtcgggtanacgtagtaacggtctaaggtcggcggtactcgtaggtacggaacgggtccgtacgttaccaaccgtactaccgtaccgaacggaccgaaccgaaaacccgaccgtaaaacccgtaaccgttccccttaggttacctaccgttaacgaaacctaagttaaccggaaacctacggtaccgagaacgtacggacgtacggaacggaacccggtacggtacctttagttaacgtttagtcgtaaacgtaacgtaaaacgtaccgtaaaccccttaacccgttacgtttttaaacgg

SEQ ID NO: 377396 - DNA, 585 bp, Homo sapiens
  misc_feature: GZ8MTXP02H00Q0.13.87.H10.1.454.CMB.2.raw
  modified_base (263)..(263): a, c, t, g, unknown or other
  modified_base (294)..(294): a, c, t, g, unknown or other
  modified_base (378)..(378): a, c, t, g, unknown or other
  modified_base (528)..(528): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtggggggaggtcttgggtacagccgtgggcagggtcccctggagactctcctgtncagccttctggattcacctttgatgatttancgccatgcctacgtggggtccggcaagcctccgaggggacgggcctgggagtgggctgaggtattaggtggaataggtggtacngatagggcttagtggacggactcgtgtgggaacgggtccgtatccgacctatcctccgagacgacaacgaccaaacgacctcctagtatcgtgacaagtagaaacagacctgagtagcgtcggacgacgacggtcttagtattattcganaacaaaacgtcctaaccctaacccgtttacgtagttttcgtaggttacggtttaacg

SEQ ID NO: 377397 - DNA, 697 bp, Homo sapiens
  misc_feature: GZ8MTXP02JCBO7.13.87.H10.1.454.CMB.2.raw
  modified_base (232)..(232): a, c, t, g, unknown or other
  modified_base (257)..(257): a, c, t, g, unknown or other
  modified_base (277)..(277): a, c, t, g, unknown or other
tcagtcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacngttattagctgatcagacaaaacgnggaaagtccctaagcctccngatctatgttgcatccatttgacgtaaaaggtcggggtacccatcgtaaaggttcaacggccggcaggttcgattcgaggggaacaggtaaactttcgaaccttctacaacgtaaactccgaagccgtaacggccctaggaccaacgtccctaggtaaaacgttagtttttcgaaacttaaaccttttaaagtttacccgtgttaaaacccttaaaccggacgtttaaccttttaaaacggttaacccgttaacccccgttacgtttaaccgggttacgggtttaccggggaacggggtaaacggggtaacgtaaacggggtacggtaaacgtaacgtaaaccgtaaaacggtacgtacgggacgtaccgtaacgtaaaccctaccgttacttcgtttaccgtttaccgtttactacccg

SEQ ID NO: 377398 - DNA, 626 bp, Homo sapiens
  misc_feature: GZ8MTXP02GB2PI.13.87.H10.1.454.CMB.2.raw
  modified_base (282)..(282): a, c, t, g, unknown or other
  modified_base (302)..(302): a, c, t, g, unknown or other
  modified_base (361)..(361): a, c, t, g, unknown or other
  modified_base (373)..(373): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctctggattcactttgatgattangccatgctacgtgggtccgnaaggctccgaggggacgggcctgggagtgggtctcgaggtattagtggaataggtggancaatgggctagnggcggaccgtccgtggacgggggcccgtattcgacccagtctacccagagaaccgaattacccgaaagaaaccacgtacgtgtttaccttacgaaaattcgaaacgtagacccgtaggaacgtacgacccgaaatcggaaccgaccgggtacccgttaggttaattaccggtgtacgggtaccgaaggacggacggttaacgggggaccccctaaaggtaacccggttacgtaccggtacgtacgttacgggg

SEQ ID NO: 377399 - DNA, 679 bp, Homo sapiens
  misc_feature: GZ8MTXP02H8HCK.13.87.H10.1.454.CMB.2.raw
  modified_base (272)..(272): a, c, t, g, unknown or other
  modified_base (294)..(294): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagccgtggcaggtcctgagactctcctgtgcagcctntggattcactttgatgtattancgcctatgcctacgtcgggtcccggacaagccgtaccggaggggaacgggcccgtgggaggtcgggtctaccgtaggttagttaggttaggaagttaggtggtagctagtaggtctaagtcggcggtactcgtggtacgggaacgggccgtattcccgacctacgttcctaccgaaggtaacgaaccgaaaccgacccaaaacgtacccgttccctaggttacctacgtaacgaacgaaaacgttacgaaacgacgtaccgtaggaacggacgtacgacgggacggaaccgtaccggtccgtttagtttacgtttagttaacggttacgtaaacgtaaaaacgtacctaacccccgtttaaacccgtttaacggtttttaacggg

SEQ ID NO: 377400 - DNA, 715 bp, Homo sapiens
  misc_feature: GZ8MTXP02HSLO1.13.87.H10.1.454.CMB.2.raw
  modified_base (268)..(268): a, c, t, g, unknown or other
  modified_base (294)..(294): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagtcttggtacagccgtggcacggtccctggagactctcctgtgcagcctcnggtacttcacctttgatgtatttacncgactagtcgacgtacggtcggtacgagacgaacgccgtaacggaggggacggtcggtagggtcggtcggtactaggtaggttagttacggtaaggtaacgtaggtacggtagacgtaagtggtacgtaggtcggtaccgtacgttagtacgggtaacgggaccggtaccgtacgtaccgtaccgtacgtaccgtacgaacgaacgaacccgaaccgaccaaacgtaaccctccgttagtacgtacgtaacgaacgtaaacgtacgaaaccgcgtacgtacggaacgtacgtacggtacggaacggtaccgttaccggttacgtttagttaacgttacgtacgtaacgtaaaccgtaaaaccgtaccccgttaaacccgttaaacccgtttaagtttacggtttaacggtaacggttacgg

SEQ ID NO: 377401 - DNA, 640 bp, Homo sapiens
  misc_feature: GZ8MTXP02GXMYC.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcttggtacagcctggcaggtccctgagactctcctgtgcacgcctcgtggacttcctacctttgatgtattatcgacctatcgctacggtcggggtcccgacaacggtccgtaccggaaggggaacgggtcccgtaggggtacggtggggttacctaccggtagggtttatttaggttaggtaaagttaggtggtaggctaaggtagggactagtcggacggtacttcgtggtaggacgggtccgtattcccactactctaccgagaacgaccaaacgaccaaagtaccctccgtagtaactctacgactaaatacgaaacacgtaccgtaggaacgtacgcgtaggacggtaccgacggttacttagtattagtaagagaactaaacgtcctaacccttaaccgtttagtttag

SEQ ID NO: 377402 - DNA, 679 bp, Homo sapiens
  misc_feature: GZ8MTXP02HF6QZ.13.87.H10.1.454.CMB.2.raw
  modified_base (294)..(294): a, c, t, g, unknown or other
  modified_base (539)..(539): a, c, t, g, unknown or other
tcagtcacgtactacacgaccggtgctcgatttagcagtactgcgttggggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcggtgggggagtcttggtacagcctggccaggtccctgacgactctcctgtcgcagcctgtggtacttctacttgatgtattancgtcctagtcgacctacggtcgggtccgacacgtccgtaccggaaggggtacgggccgtaggggtacggttgggtcctacggtaaggttagtttaggtacggtaaagttagggtaggtaagctaaggtacggtcgtaagtcggacggtctcgtaggtagggacgggtccgtatcccgactacgtcctaccgagtaaccaacgaacccgaccaaacgtacctacccgtagtactcgtagaactaanacgaactacgccgtaggacgaagtcgtaacggaacgtacgtcggttactttagtattacgtacgtaacgaactaaaacgtcccgttaaacctaacccggttagtttaacggtttacggtaacggtttacggtttaaccgg

SEQ ID NO: 377403 - DNA, 748 bp, Homo sapiens
  misc_feature: GZ8MTXP02IAHU3.13.87.H10.1.454.CMB.2.raw
  modified_base (305)..(305): a, c, t, g, unknown or other
  modified_base (442)..(442): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcactatggagttgggactgagctggtattttcctttggcttaattttaaaaggtgtccagtgtgaagtgcagctggtggagtcgtgggggaggtcttggtacagcctgggcgaggtccctggacgacctctcctgtgcagcctctggtattctaccttttgattgtattancgaccatcgccacgttcggggtcccggacaaacggccctacccggaagggggtaaccggggtcccgttaggggtacggttggggttactacccggtaaggggttattaggagttagggtaaattagggtggggtaanacgtaaaggttacggacgttagcgggtaccgggtacttcggtaggtacgggaaacgggggtccctaagtttacccgaaccctacttacccgtaaccaacggaacgaaacccgaaaccccggaccaaaaccggtaacccttacccccgttagttaacctccgtagaaactaaaacgtacggaaacctacgtacccgtaaggaaggacggccgtagggaacgaaccgtccgggttacctttagttaacgtttgtttaggaacgtaaacgaaaactacccgttaaacccccgtaaacccgttttaacgg

SEQ ID NO: 377404 - DNA, 737 bp, Homo sapiens
  misc_feature: GZ8MTXP02IFF5J.13.87.H10.1.454.CMB.2.raw
  modified_base (334)..(334): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcttggacagcctggcaggtccctgagtactctcctgtcgcacgtcctcgtggtacttcctacctttgattgtattagtcgcctatggacctacggtcggggtacccganaaacggtcctacccgggaaggggtaacggcccgtaggggtacggttcggggtaccttaccggaagggtttaagtttagggttaggtaaagtttaggggtagggtacgtacgtaaaggttacgggtacttaagtcggacggttacctcgttaggaggtaaacggggcctaagtttacccacctacgtcctaaccgagaacgaacccgaaaccgacccaaaacggtaaccctttcccgttaggttaactaccgtagaaaccgtaaaatacggaaaccacgtaccgtaaggaacgtacgaccgtaggaaacggtaaccgtaccggttacgtttacgttaattttacggtaagttacgaaaacgtaaaacgtaccctttaccccgtaaaaccgttttagtttaacgg

SEQ ID NO: 377405 - DNA, 676 bp, Homo sapiens
  misc_feature: GZ8MTXP02GNUDH.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggaggtcttggtacagccgtggcaggtccctgagactctcctgtgcagtcctgtggtattccacctttgatgtattatcgaccctatgacctacggtcggggtcccggacaacggcctaccggaaggggtaacgggccgtaggggtaggtcggggttctaccggtaggttagttaggagttaggtaaattagggtggtagcgtaagtaggcttagtcggcggtactcgtaggacgaacggggccctagttaccacccgtatccgtaccaaaggacaaaccgaaaccgaccgtaaacgacccttcccgtagtactccttaggaactaaagtcgtaaacgccgtacgtacggaaagcggtacgtacgggaacggtaaccgtaccgggttaccttagttaacgtttgtaggtaacgtaaacgaaaacgtacccgttaaccctaaaccccggtttttaagg

SEQ ID NO: 377406 - DNA, 702 bp, Homo sapiens
  misc_feature: GZ8MTXP02IBSHN.13.87.H10.1.454.CMB.2.raw
  modified_base (329)..(329): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttccttttggcttaatttttaaaaggtgtccagtgtgaagtgcagctggtggagtcgtgggggagcttggtacagcctggcaggtccctgagacttctcctgtcgcacgtcctctggtattcctacctttgatgtattatgcctatcgctacgtcggggtcccganaacggccgtacccgggaaggggtaacgggccgtaggggtacggttggggtactaccggtaaggggtttagtttagggttagggaaagtttaggggttaggtacgcgtaaggtacgggtcttaagtcggaccgggtacttcgtaggtaggaacgggtcctacttacccgacctacttcccaccgaacggacgaaccgaaaccggaacccctaaacgaacccttcccgtagttacctacgtacgaactaaagtacgaaacctacgacctaggacgtaggtacgaggaacggaccgtaccggttccgttaggttaattagttcgaagaaaccgtaaaacgtcctaaacccccgtttaaccgtttacgttttaacgg

SEQ ID NO: 377407 - DNA, 631 bp, Homo sapiens
  misc_feature: GZ8MTXP02GCYXG.13.87.H10.1.454.CMB.2.raw
  modified_base (269)..(269): a, c, t, g, unknown or other
  modified_base (288)..(288): a, c, t, g, unknown or other
  modified_base (292)..(292): a, c, t, g, unknown or other
  modified_base (308)..(308): a, c, t, g, unknown or other
  modified_base (415)..(415): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggagtcttggtacagcctggcaggtccctgagctctctgtgcagcctntgattcactttgatgattngccntgctacgtcggtccgnagcctacgaggggacggcctggagtggtctcgaggttattaggtgaatggtggtagcagttaggctaagtggcgtactcgtggtacggaacgggcgtacttcacccngttccaccgaagaacgacgaaaccgtacccgaaacgtacccctcccgttagtaacgttctacgaactaaaacgtacgaaaccgacggtacctaggaaacgtaggtaccgtaggaacggtaaacccgtacgggttaccctttaggttactttaagtaacggtaacgaaacgtaaaacggtcccctaaaaccgtaaccccgtttaacggttttaaagg

SEQ ID NO: 377408 - DNA, 737 bp, Homo sapiens
  misc_feature: GZ8MTXP02GHEBS.13.87.H10.1.454.CMB.2.raw
  modified_base (260)..(260): a, c, t, g, unknown or other
  modified_base (307)..(307): a, c, t, g, unknown or other
  modified_base (394)..(394): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttcctttggctatttaaaggtgtccagtgtgaagtgcagctggtggagtcgtgggggagcttggtacagcctggcaggtccctgacgactctacctgtgcagcctntgattcgacctttgattgactttatcgccatgacacgtgggtccganagctaccgaggggacggtccctagggagtcgggtctacgtaggtaatttggtaggaataggtggtaacgctaagttagggccttagnggacccgggtatccgttaggagggaaacggggcccgtattccaacctaactccgttacccgaagaacgacgaaaaccggaccaaaacgtaacccgttcccctaggttaaactcgttacgaccaaaaagtcgaaaaccgacgaccgttaggaaaccgggtacgacgtaacgggaacgggtaaccgtaaaccgggttacgtttaaacggttaaacgtttacggtttacgggtaaaccggtaaaccgttaaaaaccggtaacccgtttaaacccccgttaaaacccgttttaaacgggtttaaccggtttttaaccggggtaacgggtttttaaccggttaaaccg

SEQ ID NO: 377409 - DNA, 762 bp, Homo sapiens
  misc_feature: GZ8MTXP02HF4RX.13.87.H10.1.454.CMB.2.raw
  modified_base (181)..(181): a, c, t, g, unknown or other
  modified_base (267)..(267): a, c, t, g, unknown or other
  modified_base (311)..(311): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttctttggctatttaaaggngtcagtgtgaagtgcagctggtggagtcgtgggggagcgttggtacagcctggcagggtccctgagactctcctgtcgcagcctcnggatcactttgatgattatgccatggcctacgtcggggtccggnaaacggctaccgaagggggaacggcctaggggtaggtggggtctaccgaagggtttattaggttgggaaattaggtacgggttagacgtaagtacggtcgtaaagtcggaccggtactcgtaggtagggaaacgggcccggtattacctaccaacttccgaacccgaaggtaacgaacccgaaaacggttacccgaaaacggtaacccttacccgtaggttaaacgttcctaggaaacccttaaaaagtacggtaaaaccctaacggacccggttaaggaaaaccggggtacggtaaccggtaaacggtaaaccggaaccccggttaaacgggtttacccgtttaaggtttaaaacggtttaacggttaacggtaaacggtaaaaacccgtaaaaaccggttaacccgtttaaaacccccggtttaaaacccccgttttaaaggtttacgg

SEQ ID NO: 377410 - DNA, 672 bp, Homo sapiens
  misc_feature: GZ8MTXP02G1FSI.13.87.H10.1.454.CMB.2.raw
  modified_base (304)..(304): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctaattttaaaaggtgtccagtgtgaagtgcagctggtggagtcggtgggggagtcgttggtacagccgtggcacggtccctaggacgactcctctggtgcagcctcgtggtacttcacctttgatgatttancgaccagtcgctacgtcggggtacccgacaacgtccgtacccgggaaggggaacgggtcccgtaggggacggtcggggtactaccgtaagggttatttaggtagggaagttaggttgtaggacacggtaggaccttagcggccgagttcgtaggtacggtaacgggccgtagtaccacctacgtctaccgaacgacacgaaaccgtaccaaacggacctaccgtacgtacttcgaacgaacctaaatacggaaaacacgtaccgtagaacgtacggtcgaggacggaaccgtacggtacctttacgttagtttagtaagtaacgaacgtaaaactaccgtacccgttaaaccccgttagtttaaacgg

SEQ ID NO: 377411 - DNA, 668 bp, Homo sapiens
  misc_feature: GZ8MTXP02FPYKU.13.87.H10.1.454.CMB.2.raw
  modified_base (200)..(200): a, c, t, g, unknown or other
  modified_base (296)..(296): a, c, t, g, unknown or other
  modified_base (319)..(319): a, c, t, g, unknown or other
tcagtcacgtactacacgaccggtgctcgatttagcagtactgcgttgggtttgggggggaggaggagccccagccctgagattcccaggtgtttccattcagtgatcagcactgaacacagaggactcaccatggagttgggactgagctggtattttccttttggctattttaaaaggtgtccagtgtgaagtgcagntggtggagtcgtgggggaggcttggtacagccgtgggcaggtccctgagtacctctcctgtgcagtccctcgtggtacttcacctttgatgattancgaccatgcacgtcgggtccganacgctaccggaggggacggccgtgggtaggtgggtctacgaggttattaggtggtaataggtcggtagactaagtacgggctagtcggacggtactcgtgggtacggacgggtccgattccgacagtcctaccagacgaacaaccgacaaacgaccttacctagtactctagaactaaatacgaaacgacgcctaggacgacgtcgtacgggaacgtaccgaccggttccgtttaggttaaactttacggttagtaacggtaaacctaaaaacgtaaccccttaacccccgtaaacccgttttaacggtttacggttttaacgggtaaggttacgggttttaaaaccgg

SEQ ID NO: 377412 - DNA, 831 bp, Homo sapiens
  misc_feature: GZ8MTXP02HUVWO.13.87.H10.1.454.CMB.2.raw
  modified_base (502)..(502): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggaggtctttgggtacagtcctggcagggtccctggagtactcctcctgtcgcacggtccctcgtggtacttccgtacctttgattgacttatcgcctagtcgccacgtcggggtacccgagtaaacgccgtacccggaagggggtaaccggtccggttaggggaacgggtttggggtacccttacggaaaggggtttaatttagggttaagggtaaagttacgggtagggttacgcgttaaagtaggggtaccttaagtcggaccggtaacctgtttaggnggaaaaccgggggtcctaacttaccccaaaccgtacgttcccctaaccgaaagggaaccaaaccgaaaccggacccaaaaaggttaacccctccccggtattaacgttccaaggaaccctaaaaagtcggaaaaaccgtcggtaccgttaaaagaacgggggtacttacccgggtaaagggtaacccggggaaaccgaccccgggggtttaccttttaacggtttaaaaccgtttacggttaagggttaacccggaaaaacctaaaaaacggggttacccttaaaccccccccggtttaaaaccccggtttttaaaaacggtttcgggg

SEQ ID NO: 377413 - DNA, 515 bp, Homo sapiens
  misc_feature: GZ8MTXP02F8NMI.13.87.H10.1.454.CMB.2.raw
  modified_base (261)..(261): a, c, t, g, unknown or other
  modified_base (379)..(379): a, c, t, g, unknown or other
  modified_base (383)..(383): a, c, t, g, unknown or other
  modified_base (409)..(409): a, c, t, g, unknown or other
  modified_base (427)..(427): a, c, t, g, unknown or other
  modified_base (461)..(461): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagcttggtacagcctggcaggtccctgagactctcctgtgcagccctntggattcacctttgatgattatgccatgcacgtggggtccgcaagcctccgaggggaggcctgggagtggggtctcgaggtattagtggataggtgtagcatagggctatggcgactntagngaaagggccgtatcgaccatctccanaggacaacgccaaagacncactgtatctgcagtatgacagcctgagagtcgnggactcggctggtattattacgtgtagccgaagtgagtcggcgacggacttaag

SEQ ID NO: 377414 - DNA, 650 bp, Homo sapiens
  misc_feature: GZ8MTXP02G1U93.13.87.H10.1.454.CMB.2.raw
  modified_base (572)..(572): a, c, t, g, unknown or other
  modified_base (599)..(599): a, c, t, g, unknown or other
  modified_base (613)..(613): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagagactcaccatggagttgggactgagctggtattttcctttggcttaagttttaaaaggtgtccagtgtgaagtgcagcgtggtggagtcgtgggggagtcttggacagccgtggcgtacggtccctggacgtactcctcctgtgcacgtcctgtggtacttcctaccgtttggatgtaattagtcgccctagtcggaccgtacggtcggggtacccgacgaacggtcccgtaccgggaaggggtaccgggccgtagggtacgggtcggtctaccggtaggttagttaggtagggtaagttgggttacgggtagcgtagtaggtcttagtcggcgtactgtgtaggacgggcctagtccacgctacgagaagaacgtacgaaaccgacctaaagaccctccgtagtactcgtaacgactaagacgaacgactcgaagaggtacncggtagacggacgtcgtacgttagttnttagaacggtaaanaaaaccgttactacctaacccgttacgtttaagttcg

SEQ ID NO: 377415 - DNA, 884 bp, Homo sapiens
  misc_feature: GZ8MTXP02HOFDP.13.87.H10.1.454.CMB.2.raw
  modified_base (287)..(287): a, c, t, g, unknown or other
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggtcttggtacagcctggcaggtccctgagactctcctgtgcagcctgtggattccacttgatgattangccatgccacgtcgggtccgacaacgcgtaccggaaggggaacgggccgtagggtacggtgggttacctacggtagggttaagtttagggttaggtaaagttaggggttaggtaaggtcgtaaagttacgggtcttaaggttcgggtaccgggtacctttacgggtacgggggttaagggaaaccgggggtacccgttaagttacccccggtaaacccgtattaccccggttacccgaaaacgggaaaccggaaacccgaaaacccccggggaacccctaaaaacggggttaaaaccccctcccccggtttaaacgggtttaaccttcccggtttaaacggaaaacccttaaaagttaaacccggaaaacccggtaacttacccgggtaaagggtaacggacgggttacccggtaaaggggaaccgggttaaccggtaacccgggggtttccctttaaggttttaaacgtttaagtttcggaaaaccggttaaaccgaaaaacgggttaaccccctttaaacccccggtaaaaccccgtttttagggtttaaacccggtttttagggtaacggtttaacggggttttaaacccgggg

SEQ ID NO: 377416 - DNA, 765 bp, Homo sapiens
  misc_feature: GZ8MTXP02GSC5U.13.87.H10.1.454.CMB.2.raw
  modified_base (276)..(276): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaattttaaaggtgtccagtgtgaagtgcagctgggtggagtcggtgggggagtcgttggtacagccgtggcacggtccctgacgactctcctgtgcagcctntggattcctactttgatgtattatgcctatcgaccgtacggtcggggtacccgacaacggcctaccgggaaggggaacggtccggtagggaggtcggggtctaccggtaggtttagttaggttagggtaaagtaggttacgggtacgataaggttagggtaccttaaggtcggcgggtaaccttcggttaggtaacggggaacgggtacccgtaagttacccgtaaaccgtcttacccgtacccgaaagaccgaaaccgaaacccggaaccctaaaacgggtaaaccccttccccgttagttaaccgttacgaacccggtaaataaaacgtacggaaaacgacggttaccgaaggaacggacggtcgtaacgggacggtaaccggtaccggttaccgtttaacgttaagttttagtaacggtaaacgtaaaacggtaaaaccttacccgttaaaccccgtttaaccccgttttaaaggtttttaccggg

SEQ ID NO: 377417 - DNA, 681 bp, Homo sapiens
  misc_feature: GZ8MTXP02IZOEK.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcttggtacagcctggcaggtccctgagctctcctgtgcagcctcgtggtacttcctacctttgatggtattatcgcctagtgtccgtacgttcggggtccccgacgaaacggtccgtacccggaaggggacggtcccgtggggacggttcggggtctaccgtaggttagttaggttaggaacttaggtggtagctagtaggactagtcgcggtatcgtggtaggacggccgtatttccgacctctccgtaccaagacgaaccaaaccgaccaaaacggtacccttccgtacgttactcgcgaacaaagtcgaaaaccgtcgaccgtaggacgtaggaccgtagggacggtaaccgtaaccgggttccttaacgttacgtttaacgttgtaacgtaaaaccgttaaaacggacctttaaaccccccggttaaaacccgttttaaggtttttaaacggg

SEQ ID NO: 377418 - DNA, 531 bp, Homo sapiens
  misc_feature: GZ8MTXP02FR6AD.13.87.H10.1.454.CMB.2.raw
  modified_base (192)..(192): a, c, t, g, unknown or other
  modified_base (233)..(233): a, c, t, g, unknown or other
  modified_base (264)..(264): a, c, t, g, unknown or other
  modified_base (296)..(296): a, c, t, g, unknown or other
  modified_base (379)..(379): a, c, t, g, unknown or other
  modified_base (402)..(402): a, c, t, g, unknown or other
  modified_base (407)..(407): a, c, t, g, unknown or other
  modified_base (411)..(411): a, c, t, g, unknown or other
  modified_base (424)..(424): a, c, t, g, unknown or other
  modified_base (451)..(451): a, c, t, g, unknown or other
tcagtcacgtactacacgaccggtgctcgatttagcagtactgcgttgggtttgggggagtcccagtcaggacacagcatggacatgagggtccccgctcagctcctggggctcctgctgctctggctcccaggtgccagatgtgacatccagttgacccagtctccatccttctgtctgcatctgtagganacagagtcaccatcacttgccgggcagtcaggacattaacngtttattagtctaggtatcagacaaaaacgngggaaactccctaagctcctagatctatgttncatccatttgactaaaggtcgggtaccagtcgaaggttcaggtccgacagtggatcgtaggggaacaggtaactcactcctanaactaatcaagcagcctgcagcngaatntttnactaatttatacngtacaaactgtactaaatccgttaccntacgtaggtcggagacgaacgaggtgaatacgaacgaaacgtacgtggcgactaagactactacgttctcttactctacg

SEQ ID NO: 377419 - DNA, 645 bp, Homo sapiens
  misc_feature: GZ8MTXP02JG6UZ.13.87.H10.1.454.CMB.2.raw
  modified_base (302)..(302): a, c, t, g, unknown or other
tcagtcacgtactacacgaccggtgctcgatttagcagtactgcgttggggtttggggagtcccagtcaggacacagcatggacatgagggtccccgctcagctcctggggctcctgctgctctggctcccaggtgccagatgtgacatccagttgacccagtctccatccttcctgtctgcatctggtaggagacagagtcaccatccacgttgccgggtcagtcaggacattaacagttattagtctggtatacagaacaaaacgagggaacgtacctaagctccagattctatgttcgntactacctatttcgacgtaaacggtcgggtaccagtaccgtaggtcaggcccgtagacgtagactggtaggacaggtactcactactacaactaaactcgaaacgctaaacgtcccgtacgacgaacgtacccgtagtaaacggtttatttcgaaacttaacttttaaacttacttacgtacctaaataacgtactttaaaccgtccggttaaccacgttacgtagggtttaccgggaccggggtaacgggaacgtaacgggggtagtaaacggtacgaaaaccgttaaaacggattcgggaccgttagaaccggacactacgcttactccgttacttacccg

SEQ ID NO: 377420 - DNA, 638 bp, Homo sapiens
  misc_feature: GZ8MTXP02GNLFC.13.87.H10.1.454.CMB.2.raw
  modified_base (406)..(406): a, c, t, g, unknown or other
  modified_base (607)..(607): a, c, t, g, unknown or other
tcagtcacgtactacacgaccggtgctcgatttagcagtactgcgttgggtttgggggagtcagtctcagtcaggacacagcatggacatgaggtcccgctcagctcctggggctcctgctactctggctccgaggtgccagatgtgacatccagatgagccagtctccatccacctgtctgcgtctcgtcggagacgagggtcaccatcacgtttggtcgggactaagtcaagaactagttggactaactttactttaaaagttggtactcgagacgaggaacgtcgagggacaaccgccccgaacctcctaggactccgtacggtacactacccgtatttcgcaacgtaggtacggactaccccagtacccgtaaacggtttcaaaggttgaacgtagttacgngttacgtagggaaactacgttaactttttacccacgaacctcgtacgtacggggtactaacgacgtacgtagtaaagttgtttacgaacgttaccgtttattaagttcgtaacaacgtacgttacgttaacccttccgaccccggtcgttaccggacgtaacggaccgaaggtacgaaagtacgagtaccgaagtgcgtcncgacacaactctctactctactctccgtacc

SEQ ID NO: 377421 - DNA, 584 bp, Homo sapiens
  misc_feature: GZ8MTXP02GD6OZ.13.87.H10.1.454.CMB.2.raw
  modified_base (264)..(264): a, c, t, g, unknown or other
  modified_base (497)..(497): a, c, t, g, unknown or other
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagtcttggtacagcctggcaggtccctgacgactctcctgngcagtcctcgtgattcactttgatgatatgccatgcagtcgggtccgcaacgcgtaccggaggggacggccgtggagtcggtctcgtaggtattaggtaggaactggtggtagcaagttcggctagcgggtcgacgtgtggtacggaaggggcctaacgttcaccgtactctacgagacgaaccaacgaccaaacgtaccctaccagttactacacgtacaaagtacgaaacncgccgtagaaggcgtacgagacgacgtacgtacgttagtacgttagtgacgaaactaaacgtacctaacccgtaaccgtttagttag

SEQ ID NO: 377422 - DNA, 661 bp, Homo sapiens
  misc_feature: GZ8MTXP02JXO2L.13.87.H10.1.454.CMB.2.raw
  modified_base (312)..(312): a, c, t, g, unknown or other
  modified_base (534)..(534): a, c, t, g, unknown or other
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttcctttggcttatttaaaggtgtccagtgtgaagtgcagctggtggagtcggtgggggagtcgttggtacagccgtggcgacggtccctgacgtaccttcgtcctggtacgccgacgtccctcgtggtacttcctaccgtttgactgtaactttancgccagtcgcgtacggtcgggtccgacaacgtcgtaccggaaggggacggtccgtagggtaggtcggtctacgtaggttagttaggttacggaagttggtaggtacgcgtaagtagtctagtcgacgtacgtgtaggagacgggtccgtacttaccacactccaacgagacgaaccaaccgactaaacgtacctaccgtagtactcagacaaagtaccgaanacgactagacgagtacgagacggtacgtacgtcgttagttacgttagttacgaacgaacgtaaaacgtccgttaaaccccgtaaccgtttacggttacgtttacggaacggtttacgttaaaccggg

SEQ ID NO: 377423 - DNA, 764 bp, Homo sapiens
  misc_feature: GZ8MTXP02F0KLT.13.87.H10.1.454.CMB.2.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggcttaatttaaaaggtgtccagtgtgaagtgcagcgtggtggagtcggtgggggagtcgttagggtacaggcctgggccgacggttccctggacgtaccttctccgtgcgcacgcctcgtggtacttctactttgattgattactcgcctatcgcgtacggtcgggacccgtacgaacggccgtaccggaggggaacggtccgtagggtacggtcggggtactacggtaagggttacgtttaagggttacgggtaaagttagggtagggtacgtacgtaaaggttacggtacttaggtcgggtaccgggtactacgggttggtacgggaaccgggtccgtaatttacccgaaacccgtgtttacccgacgaacgtaaacgacccgtaaaccgaacccgtaaaccgtacccttaccgtgtaacgtaccgtagaacctaaaagtcgaaacgtcgtaccgtaggacgtacggtacgagggtaaccgtaccggtaaccggtttaccgttaggttaactttaacggttaacgaaaaccgttaaaacgtaaaaccggtaccctttaaaccccgtttaaaccggtttaggtttttaaacgg

SEQ ID NO: 377424 - DNA, 551 bp, Homo sapiens
  misc_feature: GZ8MTXP02H3WHI.13.87.H10.1.454.CMB.2.raw
  modified_base (189)..(189): a, c, t, g, unknown or other
  modified_base (236)..(236): a, c, t, g, unknown or other
  modified_base (264)..(264): a, c, t, g, unknown or other
  modified_base (266)..(266): a, c, t, g, unknown or other
  modified_base (271)..(271): a, c, t, g, unknown or other
  modified_base (299)..(299): a, c, t, g, unknown or other
  modified_base (379)..(379): a, c, t, g, unknown or other
  modified_base (381)..(381): a, c, t, g, unknown or other
  modified_base (389)..(389): a, c, t, g, unknown or other
  modified_base (405)..(405): a, c, t, g, unknown or other
  modified_base (425)..(425): a, c, t, g, unknown or other
  modified_base (456)..(456): a, c, t, g, unknown or other
  modified_base (461)..(461): a, c, t, g, unknown or other
  modified_base (464)..(464): a, c, t, g, unknown or other
  modified_base (469)..(469): a, c, t, g, unknown or other
  modified_base (471)..(471): a, c, t, g, unknown or other
  modified_base (479)..(479): a, c, t, g, unknown or other
tcagtcacgtactacacgaccggtgctcgatttagcagtactgcgttgggtttggggagctctgggagaggagcccccagccctgagattcccaggtgtttccattcagtgatcagcactgaacacagaggactcaccatggagttgggactgagctggtatttttcctttggcttaattttaaaaggngtccagtgtgaagtgcagctggtgagtcgtgggggagcgttggtacngcctggcaggtccctgagctctcgtgtncngcctngtacttcactttgatgattatgccagtncacggtcgggtccgacaagccgtacgaggggtaacggccgtggagtcggtcctagaggttataggtagagttagacggtnanagtacggnttagcgcgtatcgtgnggaacggtcctatcccaacntccgcaagctaacaacgctaaacgaccttcngtacnganacaananacacgacngagacgagagacgacgacgtacgtacgtatataagtacgtaacgaaactaactacctaaccttaacgttacg

SEQ ID NO: 377425 - DNA, 515 bp, Homo sapiens
  misc_feature: GZ8MTXP01CY4W7.25.20.B09.1.454.CMB.2.raw
  modified_base (271)..(271): a, c, t, g, unknown or other
  modified_base (507)..(507): a, c, t, g, unknown or other
  modified_base (509)..(515): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttatttactttgtctcctggtaccaacaacacccaggacaaacgccccaaacttatcattatgagccactaagcgcctcagagttctaatcgcttcnctggctccaagtctgcagcacggcctccctgacaactctctgggctccgaggctgaggacgaggcctgattatactgactactcatatggacacatacacaaatccctcttcgacctggaccagggtccaccgtccgtgggcacgacccgaacggccaaaccccactcgtaccacctcctcgttccccacccctcctacactcgtacaagtcttggagcggcgtgcgaggccgaanannnnnnn

SEQ ID NO: 377426 - DNA, 529 bp, Homo sapiens
  misc_feature: GZ8MTXP01ADG3O.25.20.B09.1.454.CMB.2.raw
  modified_base (236)..(236): a, c, t, g, unknown or other
  modified_base (274)..(274): a, c, t, g, unknown or other
  modified_base (492)..(492): a, c, t, g, unknown or other
  modified_base (524)..(529): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaacgcccccaaacttatcatttangagccactaagcggcctcaggagtttctaatcgcttcnctggctccaagtctggcagcacggcctcctgacatctctgggctccaggctggaggacgaggcctgatttatactgctactcatatgacacatcaacaactcccgtcttcggacctgggaccagggtccaccgtcctggggtccacgacccgaacggccccaaaccccgatcgtccacctcctccgttccccacccttcctcgactcgtcaagttcgnggcggcggcgtcggacgacggcgtaacagtgnnnnnn

SEQ ID NO: 377427 - DNA, 238 bp, Homo sapiens
  misc_feature: GZ8MTXP01AG3CM.25.20.B09.1.454.CMB.2.raw
  modified_base (237)..(238): a, c, t, g, unknown or other
tcagactgtacagtcacgaccggtgctcgatttagtgtagtgtgaagggtttggtggtctccactcccgccttgacgaggctgattattactgctactcatatggacacatcacaaatcccgtcttcggacctgggaccagggtcaccgtcctgggtcagcccaaggccaaccccactgtcactctgttcccgccctcctcactgtacagtctgagcgggctggcaaggcgcatagnn

SEQ ID NO: 377428 - DNA, 499 bp, Homo sapiens
  misc_feature: GZ8MTXP01BD5GQ.25.20.B09.1.454.CMB.2.raw
  modified_base (242)..(242): a, c, t, g, unknown or other
  modified_base (281)..(281): a, c, t, g, unknown or other
  modified_base (334)..(334): a, c, t, g, unknown or other
  modified_base (360)..(360): a, c, t, g, unknown or other
  modified_base (364)..(364): a, c, t, g, unknown or other
  modified_base (435)..(435): a, c, t, g, unknown or other
  modified_base (439)..(439): a, c, t, g, unknown or other
  modified_base (441)..(441): a, c, t, g, unknown or other
  modified_base (451)..(451): a, c, t, g, unknown or other
  modified_base (459)..(459): a, c, t, g, unknown or other
  modified_base (462)..(462): a, c, t, g, unknown or other
  modified_base (482)..(482): a, c, t, g, unknown or other
  modified_base (492)..(499): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgctaggttattactttgtctcctggtaaccaaacaacacccaggacaaaacgcccccaaaattatcattttangagccaactaagcgccctcaggagtttctaatcgcttcnctggctccaagtctggcagcatgccctcctgacaatctctgggctccagttcngagacgaggctgattatactgctaancatntgacacatcacaaactcctcttcggactggaccacgggtcaccgtctggcagcccaagggccctaaacccnctcncnctctctcccncctcctcnctntaactgttctgcggcggtcncggcacggcnnnnnnnn

SEQ ID NO: 377429 - DNA, 501 bp, Homo sapiens
  misc_feature: GZ8MTXP01AO38J.25.20.B09.1.454.CMB.2.raw
  modified_base (276)..(276): a, c, t, g, unknown or other
  modified_base (368)..(368): a, c, t, g, unknown or other
  modified_base (396)..(396): a, c, t, g, unknown or other
  modified_base (490)..(490): a, c, t, g, unknown or other
  modified_base (494)..(494): a, c, t, g, unknown or other
  modified_base (496)..(501): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaacgcccccaaaacttatcatttatgagccactaagcggccctcaggagtttctaatcgcttcnctggctccaagtctggcagcacggcctccctgacaatctctgggctccaggctgaggacgaggcctgattatactgctactcatatggacanatcacaaatcccgtcttcggactggacngggtcacgtcctgggcagcccaaggccaacccactgcactctcgttcccgccctcctcactgtaccaagtccttgcgcgggctgggcacgggcnctangnnnnnn

SEQ ID NO: 377430 - DNA, 587 bp, Homo sapiens
  misc_feature: GZ8MTXP01C0WA7.25.20.B09.1.454.CMB.2.raw
  modified_base (258)..(258): a, c, t, g, unknown or other
  modified_base (272)..(272): a, c, t, g, unknown or other
  modified_base (276)..(276): a, c, t, g, unknown or other
  modified_base (352)..(352): a, c, t, g, unknown or other
  modified_base (582)..(585): a, c, t, g, unknown or other
  modified_base (587)..(587): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgattgttgctaggtttatttactttgtctcctaggtaccaaacacacccaggacaaacgccccaaattatctattatgacgcactaagcgccctnagtatttctatcgnttcnctagctccaagtctggcagcatcggcctcctgacatctctggctccagtctgaggacgacggctagtattatactntactctatagtagacgacacactacaactaacctccgtacgtacggaccgtacgggaaccgtacggtacctaccggtcgtacgggaccacccgaaccccgaaccgggacccctaaacccctcgttccgtaccctaccttcccgttacccttaccccctacccttccgtacctaccgtacgtaacctcgttccgtaggccgggtcggtcgttcggacgacggtcagaacannnngn

SEQ ID NO: 377431 - DNA, 503 bp, Homo sapiens
  misc_feature: GZ8MTXP01ED7EJ.25.20.B09.1.454.CMB.2.raw
  modified_base (274)..(274): a, c, t, g, unknown or other
  modified_base (498)..(503): a, c, t, g, unknown or other
tcagactgtacagtcacgaccggtgctcgatttagtgtagtgtgaagggctggatgacttgggatggggagagagacccctccctgggatcctgcagctcctgcctccgtgtctgggtctcctggacagtcgatcaccatttcctgcactggactcagcactgatgttgcaggttattactttgtctcctggtaccaacaacacccaggcaaagcccccaaacttatcatttatgaggccactaagcggccctcaggagtttctaatcgcttcnctggctccaagtctggcagcacggcctccctgacaatctctggctccaggctgaggacgaggcctgattatactgctactcatatggacacatcacaaatcccgtcttcggacctgggaccagggtcaccgtcctgggtcacgcccaaggcccaaccccactcgtcactctcgttcccaccctcctcactgtacaagtcttgcgcggctggcaggcgcataagnnnnnn

SEQ ID NO: 377432 - DNA, 574 bp, Homo sapiens
  misc_feature: GZ8MTXP01D4C7H.25.20.B09.1.454.CMB.2.raw
  modified_base (254)..(254): a, c, t, g, unknown or other
  modified_base (270)..(270): a, c, t, g, unknown or other
  modified_base (291)..(291): a, c, t, g, unknown or other
  modified_base (305)..(305): a, c, t, g, unknown or other
  modified_base (332)..(332): a, c, t, g, unknown or other
  modified_base (339)..(339): a, c, t, g, unknown or other
  modified_base (428)..(428): a, c, t, g, unknown or other
  modified_base (468)..(468): a, c, t, g, unknown or other
  modified_base (473)..(473): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagccgtgggagtcctgagctctcctgtcagcctnggttcatgtcagtccntactatacacgtcgggtcccncacggccccccggngaaggggctgggagtgggtgctcttanctcatangatacggaaatgttaaatactcgacccgactccgtagaaacgggcctattccgcgtctaccagacacaactccaagaacgtacggtttnttcacgacacgtcgaacgcgtaggaagtaagtggacgacncggtnttagtaattagttcgtgtcgtcgtcgttactttcctccttcccgtacgtccttccgcccttactaacctaactaacgttctacttctaacgttcgtaacgg

SEQ ID NO: 377433 - DNA, 549 bp, Homo sapiens
  misc_feature: GZ8MTXP01CMKST.25.20.B09.1.454.CMB.2.raw
  modified_base (312)..(312): a, c, t, g, unknown or other
  modified_base (397)..(397): a, c, t, g, unknown or other
  modified_base (402)..(402): a, c, t, g, unknown or other
  modified_base (424)..(424): a, c, t, g, unknown or other
  modified_base (448)..(448): a, c, t, g, unknown or other
  modified_base (457)..(457): a, c, t, g, unknown or other
  modified_base (465)..(465): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttggggtttttcctcgttgcttctttttaagagatgtccagtgtcaagtgcacctggtggagtcgtgggggagcgtggtccagcctgggagtcctgagctctcctgttcagcctctggtcatgttcagtcctctactatacacgtggtcccgccacggcccccccggngaacggggctgggagtcgggtgctcgttatctcatatgataggaaatgtaaatactacgcaactcgtagaacgggcatcgccgtncaganacaactcaagacacgttgttcngcaacgtgaacgctggaagaatgngacacggtntagtaatntacgtgtcgcgtcttactttcctccttcccgtcgtccttccgcccttaccttaacctaactaacgtctcttactaacgttcgtg

SEQ ID NO: 377434 - DNA, 540 bp, Homo sapiens
  misc_feature: GZ8MTXP01A0GEX.25.20.B09.1.454.CMB.2.raw
  modified_base (308)..(308): a, c, t, g, unknown or other
  modified_base (418)..(418): a, c, t, g, unknown or other
  modified_base (424)..(424): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagcctgggagtccctgagctctcctgttcagcctctgggttcatgttcagtcctctactatacactgggtcccgccagcccccccggnaacggggctggacgtgggtggctcttatctcatatgatggaatgtaaatactacgccgactccgtgaacgggccgatcgccgtctccagagacaactcaagaacacggtntttacngacactgaacgcctagggaagaaagtgtacggacacgggctgtatattactgttgcgcgtatttctccttccctcgcttcgcccactcctacaacgtctcttctaattcgtaacgg

SEQ ID NO: 377435 - DNA, 532 bp, Homo sapiens
  misc_feature: GZ8MTXP01DR137.25.20.B09.1.454.CMB.2.raw
  modified_base (307)..(307): a, c, t, g, unknown or other
  modified_base (343)..(343): a, c, t, g, unknown or other
  modified_base (422)..(422): a, c, t, g, unknown or other
  modified_base (466)..(466): a, c, t, g, unknown or other
  modified_base (485)..(485): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagcctgggagtccctgagctctcctgttcagcctctgggttcatgtcagtcctctactatacactgggtcccgccacgccccccggngaaggggctgggagtgggtggctctttatctcatangatggaaatgttaaatactacgccgaactccgtgaaacgggccattccgcgtctccagagacaactcaagaacacggtnttctgcactgaacgctaggagaaatgtagacacggctagtaatnttactgtgcgcgtatttcncttcccgtcgcttcgcccactctacgaactgtcttctaacttctcgg

SEQ ID NO: 377436 - DNA, 568 bp, Homo sapiens
  misc_feature: GZ8MTXP01EUP4N.25.20.B09.1.454.CMB.2.raw
  modified_base (248)..(248): a, c, t, g, unknown or other
  modified_base (265)..(265): a, c, t, g, unknown or other
  modified_base (285)..(285): a, c, t, g, unknown or other
  modified_base (297)..(297): a, c, t, g, unknown or other
  modified_base (314)..(314): a, c, t, g, unknown or other
  modified_base (525)..(525): a, c, t, g, unknown or other
  modified_base (549)..(549): a, c, t, g, unknown or other
  modified_base (560)..(560): a, c, t, g, unknown or other
  modified_base (562)..(568): a, c, t, g, unknown or other
tcagactgtacagtcacgaccggtgctcgatttagtgtagtgtgaagggctggatgacttggggatgggggagagagaccccctcccctgggatcctgcagctcctgcctccgtgtctgggtctcctggacagtcgatcacctatttcctgcactggactcagcactgattgttgctaggtttatttactttgtctcctaggtaccaacaacacccgaggaccaaacgcccctaaattatctatttangagccaagtagcgcctnaggtagttctatcgtcttcnctgctacagtcnggcagccacgcctcctnacactctcgtggcctcgagtctaggaggacgagtcctagtatttactagtcacttactcgtatagtagactacatacaactaacttcccgtcttaccgggactacgggaccgtacgggtcctaccggtcgtacgggccaccgacccgaaccgacccctacccgtactctacctacctctacccttccccacccttccgactactctaaccngtcgttggacgttcggcgcggacncgggacctaanannnnnnn

SEQ ID NO: 377437 - DNA, 550 bp, Homo sapiens
  misc_feature: GZ8MTXP01DWOE0.25.20.B09.1.454.CMB.2.raw
  modified_base (233)..(233): a, c, t, g, unknown or other
  modified_base (242)..(242): a, c, t, g, unknown or other
  modified_base (291)..(291): a, c, t, g, unknown or other
  modified_base (355)..(355): a, c, t, g, unknown or other
  modified_base (364)..(364): a, c, t, g, unknown or other
  modified_base (540)..(540): a, c, t, g, unknown or other
  modified_base (543)..(548): a, c, t, g, unknown or other
  modified_base (550)..(550): a, c, t, g, unknown or other
tcagactgtacagtcacgaccggtgctcgatttagtgtagtgtgaagggctggatgacttgggatggggagagacgacccctcccctgggatcctgcagctcctgcctccgtgtctgggtctcctggacagtcgatcaccatttcctgcactggactcagcatgatgttgctaggtttattactttgtctcctaggtaccaaacaacacccaggacaaacgcccccaaaattntctatttangagcataagcgcctgagtattcaatcgctcactgctcaagtctggtacnctaccggcctcctagacaactctcgtggctccgaggctggacgacgagctagactttatacgtnactaactangtatacgacacatacaactaaacgtcccgtacgtcgacgtgggacctaggtccaccgtcgtgggacacgacccaagtcccaaacccgctcgtacctacttccttcccgttacccctacctccgtactacgttcgtacgtcgtaacgtggacggcggttacgcgacgacgcgacaanagnnnnnngn

SEQ ID NO: 377438 - DNA, 572 bp, Homo sapiens
  misc_feature: GZ8MTXP01EGL9W.25.20.B09.1.454.CMB.2.raw
  modified_base (256)..(256): a, c, t, g, unknown or other
  modified_base (295)..(295): a, c, t, g, unknown or other
  modified_base (310)..(310): a, c, t, g, unknown or other
  modified_base (450)..(450): a, c, t, g, unknown or other
  modified_base (555)..(555): a, c, t, g, unknown or other
  modified_base (558)..(558): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagcctgggagtccctgagactctcctgttcagcctntgggttcatgttcagtcctctactatacactgggtcccnccacgcccccccggnaaggggctgggacgtgggtggctcgttatctcatatgattcggaaattgttaaaactctacgacccgactccggtagaaacggggccctattccgcccgtctaccagacgacaactcccaaagaactaacggtcgtttcncgacaaacgtggaaacgccttagggaagtaaagtgtaggacacggtctagtattattactgtcgcgtgtactttctcttccctcgcttcgcccactctacaactntcnctaacttcgtaacg

SEQ ID NO: 377439 - DNA, 518 bp, Homo sapiens
  misc_feature: GZ8MTXP01APP87.25.20.B09.1.454.CMB.2.raw
  modified_base (256)..(256): a, c, t, g, unknown or other
  modified_base (275)..(275): a, c, t, g, unknown or other
  modified_base (384)..(384): a, c, t, g, unknown or other
  modified_base (442)..(442): a, c, t, g, unknown or other
  modified_base (482)..(482): a, c, t, g, unknown or other
  modified_base (486)..(486): a, c, t, g, unknown or other
  modified_base (510)..(511): a, c, t, g, unknown or other
  modified_base (513)..(518): a, c, t, g, unknown or other
tcagactgtacagtcacgaccggtgctcgatttagtgtagtgtgaagggctggatgacttgggatggggagagagacccctccctgggatcctgcagctcctgcctccgtgtctgggtctcctggacagtcgatcaccatttcctgcactggactcagcactgatgttgcaggttattactttgtctcctggtaccaacaacacccaggcaaaacgccccaaacttatcatttatgaggccaactaagcggccctnaggagtttcaatcgcttcnctggctcaagtctggcagcacggcctcctgacatctctgggctcaggctgaggacgaggcctgattatactgacttactcatatggacacatacgaacaaactcccgtnttcggacctgggaccagggtccacgtccgtgggcacgcccgaacggtcccaaaccccncgtcgtcacctcttccgtcccctccctactcacgtcgtcngtcnggcggcgggctggacgacggcctnngnnnnnn

SEQ ID NO: 377440 - DNA, 670 bp, Homo sapiens
  misc_feature: GZ8MTXP01D7ONF.25.20.B09.1.454.CMB.2.raw
  modified_base (241)..(241): a, c, t, g, unknown or other
  modified_base (251)..(251): a, c, t, g, unknown or other
  modified_base (262)..(262): a, c, t, g, unknown or other
  modified_base (271)..(271): a, c, t, g, unknown or other
  modified_base (280)..(280): a, c, t, g, unknown or other
  modified_base (291)..(291): a, c, t, g, unknown or other
  modified_base (471)..(471): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagtcttgggtttttcctcgttgcttcttttaagagatgtcagtgtcaagtgcacgtggtggagtcgtgggggagcgtggtccagccgtgggagtcctganctctctgtcngcctgtggtcntgtcatctntactatacncgtcggtcccnccaccggcccccggagacggggtcgtggaggtggtggtcttctttatctacatagtagagttaaggtaaattacgttaaaataccgtaccgaacccgtacgtcggtagggaaccgggccctagttcccgaccgtctaccaaggactaacctaacgtaccgaaagtaaccgttaacggttntttaccgagacctaaacgtacggaaaccgtcgtaaggggaacgtaaagttcggtaacggacgtacggtcgtttagttaaagttcgtttaacgtcgttcggccgttcgtttactttccctcccgttcccgtccggtacttcccgccccttacttaaccctaactaaccgttctcccttagtaaccgttcgttaaccgggg

SEQ ID NO: 377441 - DNA, 642 bp, Homo sapiens
  misc_feature: GZ8MTXP01DL0A4.25.20.B09.1.454.CMB.2.raw
  modified_base (256)..(256): a, c, t, g, unknown or other
  modified_base (292)..(292): a, c, t, g, unknown or other
  modified_base (306)..(306): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagccgtgggagtccctgagactctcctgtcagcctntggtcatgtcagtcctctactatacacgtggtcccnccacgccccccggngaagggctgggagtgggtgcttctttatctcatatgactaggtaaatagttaaactactaccggaacctacgtccggtaggaaccgggcccgtaacgttccgccgtcgtacccgaagaacgtaacctaaacgtaccgaaaacggtaaaccgtacggggtttacttttcgtacggaacctaaacgtcggaaaccgggtcccttagggggaaacgtaaagtggtacgggacctaacgggtcttaggttatattacgtgtcgcggtctatttccctccttcccgtcgaccttcgccccttaactcctaaacgtaacttctccttctaacttcgtaacgg

SEQ ID NO: 377442 - DNA, 860 bp, Homo sapiens
  misc_feature: GZ8MTXP01AOBD6.25.20.B09.1.454.CMB.2.raw
  modified_base (284)..(284): a, c, t, g, unknown or other
  modified_base (305)..(305): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgcttcttttaagagatgtccagtgtcaagtgcaccgtggtggagtcgtgggggagcgtggtccagccgtggggacggtccctgacgactctcctgttcagcctcgtggttcattgtcagtcctntactatacacgtcgggtcccnccgacggcccccccgggagaacgggggtcctggggaggtgggggtcggcttcgttaatcctatatagtaggaagttacggggtaaaaatttgggtttaaaaactaccgtaccggacccgtaaccgttcccggttagggaaaccgggggtccctaacgtttccccgggcccgttaccgtaccccgaaggtaacggaaacccctaaaaccgttacccgaaaacggtaaacccgttaaccgggggtttctttttacccgacgaacccgtaaaccgttacgggaaacccgggggttcccttaaggggggaaaaccgtaaaacggtttggggtaaccgggaaaacctccccgggggtacgtttaacgggtttaaatttaaacgtttacccggtagggttaccgggtaccggttcggtttaaaccgtttttcccgtccccttcccccggttaaaccgggtccccgttcccgttcccccgttaaaccccgtttaacccgttaaaaccccgtaacctttccgggttaaacccttccgttaaactttcccccggttaacggggg

SEQ ID NO: 377443 - DNA, 625 bp, Homo sapiens
  misc_feature: GZ8MTXP01ESHQ2.25.20.B09.1.454.CMB.2.raw
  modified_base (311)..(311): a, c, t, g, unknown or other
  modified_base (352)..(352): a, c, t, g, unknown or other
  modified_base (372)..(372): a, c, t, g, unknown or other
  modified_base (463)..(463): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgcttcttttaagagatgtccagtgtcaagtgcactggtggagtcgtgggggagcgtggtccagccgtgggacgtcctgacgctctctgtcagcctgtggttcatgttcagttcctctactatacacgtcggtcccgccaccggccccccggngaaggggctgggaggtgggtggcttcgtttatctacattangtataggaaattagttaaanactaccgaccgtacgtccgtagaacgggtcctacgtccgccgtctacccgagtacgaaccaactaccgaaagaacgtacggttcgtttacngacaacgtggaacgtccgtaggaagtaaaggtcgtacgggaactcggactttaggtaacttagttaccgtggtcgtcgtaacgttcttttccctccgttccccgtcggtcccttcggccccttactctaaccaacgttgtcccttatcgttccgttaacggg

SEQ ID NO: 377444 - DNA, 767 bp, Homo sapiens
  misc_feature: GZ8MTXP01CAZVH.25.20.B09.1.454.CMB.2.raw
  modified_base (747)..(747): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgcttcttttaagagatgtccagtgtcaagtgcacctggtggagtcgtgggggagcgtggtccagccgtgggagtccctgagactctcctgttcagtccctcgtgggttcattcgttcacgttcctactacttataccacgttcggtccccgccgacggccccccggaggaaggggccgtgggaggtgggtcggtcttctttatcgtacattagtagtaattaagggtaaaatttaggttaaaacttacccgtaacccggtaacccggtaaccgtttcccgggtagggaaaacccgggggtcccgtaacgtttccccgggaccccgtttaccgtacccgtaaacggaacgaaacccaaaccgtacccgaaaacggtaaaccgtttaacccgggtttcgtttacccgttacggacctaaaccgttaccgggaaaccgggtaccctaagggggtaaacgtaaaagggttcggtacgggaaaccgtacggggtcctttaagggttaaacttacgttaccgttagtagtcgtaacgttaccgtttctcccgttccctccgtcgttccgttcccttacttcctactaaccgttntccttactcttcgttaacgg

SEQ ID NO: 377445 - DNA, 560 bp, Homo sapiens
  misc_feature: GZ8MTXP01BBWPL.25.20.B09.1.454.CMB.2.raw
  modified_base (171)..(171): a, c, t, g, unknown or other
  modified_base (258)..(258): a, c, t, g, unknown or other
  modified_base (313)..(313): a, c, t, g, unknown or other
  modified_base (439)..(439): a, c, t, g, unknown or other
  modified_base (468)..(468): a, c, t, g, unknown or other
  modified_base (473)..(473): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagngatgtccagtgtcaagtgcacctggtggagtcgtgggggaggcgtggtccagcctgggaggtccctgagactctcctgttcagcctntgggttcatgtcagtcctctactatacactcgggtcccgccacggcccccccggngaacgggggctgggagtggggtggctcttatctcatatgataggaaatgttaaatactacgaccactccgtggaacgggccgattccgccgtctccagagacaactccaagaacacggttgtttcngacaactggaacgcctagggaagaactgnggacncggctagtattattacgtggtcgcgtcgtatttcctccttccctcgcttcgcccttactctaacaactcgtcttcaattcgtaacgg

SEQ ID NO: 377446 - DNA, 482 bp, Homo sapiens
  misc_feature: GZ8MTXP02G7DQG.25.20.B09.1.454.CMB.2.raw
  modified_base (312)..(312): a, c, t, g, unknown or other
  modified_base (447)..(447): a, c, t, g, unknown or other
  modified_base (472)..(472): a, c, t, g, unknown or other
  modified_base (475)..(475): a, c, t, g, unknown or other
  modified_base (477)..(482): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaagccccaaattatcatttatgaggccactaagcggccctcaggagtttctaatcgcttctctggctccaagtctggcagcacggcctccctgacatctntgggctccaggctgaggacgaggcctgattatactgctactcatatgacacatcacaaatccctcttcgactggaccaggtcaccgtctggcagccaggccacccactgtcactctctcccacctctcactgacncgtctgcgcgggctacggcaaggcncanannnnnn

SEQ ID NO: 377447 - DNA, 524 bp, Homo sapiens
  misc_feature: GZ8MTXP02JB6GH.25.20.B09.1.454.CMB.2.raw
  modified_base (295)..(295): a, c, t, g, unknown or other
  modified_base (308)..(308): a, c, t, g, unknown or other
  modified_base (457)..(457): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtctgggggaggcgtggtccagcctgggaggtccctgagactctcctgttcagcctctgggttcatgtcagttcctctactatacactgggtccnccagccccccggnaaggggctggagtgggtggctcttatctcatatgatggaaatgttaaatactacgccgactccgtgaagggccgatcgcgtctccagagacaactccaaagaacacgtgttactgcaactgaaacggcctagagaaatgtggacacggntagtatattactgtgcgctacttctcctcctcgcctacgccacctctacaactactctctactctcg

SEQ ID NO: 377448 - DNA, 371 bp, Homo sapiens
  misc_feature: GZ8MTXP02G4Z1Z.25.20.B09.1.454.CMB.2.raw
  modified_base (332)..(332): a, c, t, g, unknown or other
  modified_base (364)..(371): a, c, t, g, unknown or other
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttccccctggcgccctgctccaggagcacctctgggggcacagcggcccctgggctgcctggtcaaggctacttccactgtacngtctgagcgggccgtggcgaaggacgcatagnnnnnnnn

SEQ ID NO: 377449 - DNA, 510 bp, Homo sapiens
  misc_feature: GZ8MTXP02IA2V1.25.20.B09.1.454.CMB.2.raw
  modified_base (385)..(385): a, c, t, g, unknown or other
  modified_base (414)..(414): a, c, t, g, unknown or other
  modified_base (439)..(439): a, c, t, g, unknown or other
  modified_base (474)..(474): a, c, t, g, unknown or other
  modified_base (502)..(502): a, c, t, g, unknown or other
  modified_base (504)..(510): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaagcccccaaattatcatttatgaggccactaagcggccctcaggtagtttctaatcgcttctctggctccaagtctggcagcacggcctccctgacaatctctgggctccaggctgaggacgaggcctgattatactgctactcatatggacacatcaaacaaactcccgtnttcggacctgggaccagggtccaccgtcngggtcagacccaaggcccaaacccntgtcactcctcttccccacctcctcactgtaaccncgtctgacgcgggctgggccaggccaangnnnnnnn

SEQ ID NO: 377450 - DNA, 506 bp, Homo sapiens
  misc_feature: GZ8MTXP02FM3DS.25.20.B09.1.454.CMB.2.raw
  modified_base (462)..(462): a, c, t, g, unknown or other
  modified_base (501)..(506): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaagcccccaaacttatcatttatgaggccactaagcggccctcaggagtttcaatcgcttctctggctccaagtctggcagcacggcctccctgacaatctctgggctccaggctgaggacgaggcctgattattactgctactcatatggacacatcacaaatcccgtcttcggacctgggacccagggtccacgtcctgggtcagcccaaggcccaaccccactcgtcactctcgttcccgccctccncactgtacagtctgacgcgggctggcaaggcgcgatagnnnnnn

SEQ ID NO: 377451 - DNA, 510 bp, Homo sapiens
  misc_feature: GZ8MTXP02GU0O1.25.20.B09.1.454.CMB.2.raw
  modified_base (501)..(501): a, c, t, g, unknown or other
  modified_base (503)..(503): a, c, t, g, unknown or other
  modified_base (505)..(510): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaagccccaaattatcatttatgaggccactaagcggccctcaggagtttctaatcgcttctctggctccaagtctggcagcacggcctccctgacaatctctgggctccaggctggaggacgaggcctgattattactgcttactcatatggacacatcacaaactcccgtcttcgactgggacccagggtccaccgtcctgggtccagacccaacggcccaaccccatcgtccactctcgtcccaccctcctcactgtaccagtcctgacgcgggctggcaggcgaananannnnnn

SEQ ID NO: 377452 - DNA, 500 bp, Homo sapiens
  misc_feature: GZ8MTXP02F5WR7.25.20.B09.1.454.CMB.2.raw
  modified_base (452)..(452): a, c, t, g, unknown or other
  modified_base (457)..(457): a, c, t, g, unknown or other
  modified_base (494)..(500): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaacgcccccaaattatcatttatgaggccactaagcggccctcaggagtttctaatcgcttctctggctccaagtctggcagcacggcctcctgacaatctctgggctccagctgaggacgaggcctgattatactgctactcatatggacacatacactaaactcccgtcttcggactcgggaccgaggtccaccgtctgggacacgcccaaggcccaacccatcgcactctcgtcccncctcncactcgtacacgtcagcgcggctggcaagccgaagannnnnnn

SEQ ID NO: 377453 - DNA, 601 bp, Homo sapiens
  misc_feature: GZ8MTXP02FRB22.25.20.B09.1.454.CMB.2.raw
  modified_base (293)..(293): a, c, t, g, unknown or other
  modified_base (307)..(307): a, c, t, g, unknown or other
  modified_base (438)..(438): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagccgtgggagtcctgagactctcctgtcagcctgtggttcatgttcagttcctctactatacactgggtccnccacgccccccggngaagggctggagtgggtgctcttatctcatatgataggaaatgtaaatactacgccgactccggtagaacgggcctacttccgaccgtctaccgagacgaccaactaccaaagaaccgtacggtgtttacngaccaaacgtcggaaaccggtcctaggaaacgaaagtggtacgggaaccgacgggtacttagtatttagttacgtggtacgcgtacgttactttcctcccttcccgtcggccttccgacccctacttaaccgtaactaacttctaccttcacttccttacggg

SEQ ID NO: 377454 - DNA, 517 bp, Homo sapiens
  misc_feature: GZ8MTXP02GYWPT.25.20.B09.1.454.CMB.2.raw
  modified_base (508)..(508): a, c, t, g, unknown or other
  modified_base (510)..(510): a, c, t, g, unknown or other
  modified_base (512)..(517): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacaccagcaaacgccccaaattatcatttatgaggccactaagcggccctcaggtagtttctaatcgcttctctggctccaagtctggcagcacggcctccctgacatctctggctcaggctgaggacgagcctgattatactgctactcatatgacacatcaacaaactcccgtcttcgaccgtggaccgagggtccacgtccgtgggtacacgacccgaacggacccaaccccactcgtacacctcgtccttcccccaccctcctcactgtacacgtcgtagcgcgggctcggacaaggcgtaananannnnnn

SEQ ID NO: 377455 - DNA, 527 bp, Homo sapiens
  misc_feature: GZ8MTXP02I24TI.25.20.B09.1.454.CMB.2.raw
  modified_base (463)..(463): a, c, t, g, unknown or other
  modified_base (522)..(527): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaagcccccaaacttatcatttatgaggccactaagcggccctcaggagtttctaatcgcttctctggctccaagtctggcagcacggcctccctgacatctctggctccaggctgaggacgaggcctagattattactgctactcatatcggacacatcaacaaactcccgtcttcgacctcgggaccagggtccaccgtccgtgggtcacgcccaacggcccaaccccgctcgtcactctccgttccccnccctcctccactcgtacacgtctaggacgcgggtcgtcggaccaaggccgcaagtacgnnnnnn

SEQ ID NO: 377456 - DNA, 680 bp, Homo sapiens
  misc_feature: GZ8MTXP02INYH7.25.20.B09.1.454.CMB.2.raw
  modified_base (156)..(156): a, c, t, g, unknown or other
  modified_base (297)..(297): a, c, t, g, unknown or other
  modified_base (311)..(311): a, c, t, g, unknown or other
  modified_base (344)..(344): a, c, t, g, unknown or other
  modified_base (360)..(360): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctggggttttccncgttgctcttttaagagatgtccagtgtcaagtgcacctggtggagtcgtgggggagcgtggtccagcctgggacgtcctgagactctcctgttcagcctgtgggttcatgtcagttcctcgtactatacacgtgggtccnccacgccccccggngaacgggctggagtggtgctcgttatctcatangatggaaatgttaaanctacgccgtactccggtagaacgggcctagttccgccgtctaccgagtacgaactaccgtaccgaaaggtaaccgtacggtttacgtttaccgtagtaccgtaacgtacggaaccgggtacccttaggaaacggttaaaacgtcggggtacgggtaaaccgtacgggtacgtttacggttaacttaacgtttaacgtcggtacggtccgtacggttaacttttccgtacccgttacccgtccggtacctaccgggtacccctaacggttccttaaacgaacccgtttcggtaccttaccgtacgtttacgtaacccgggg

SEQ ID NO: 377457 - DNA, 561 bp, Homo sapiens
  misc_feature: GZ8MTXP02JYTS4.25.20.B09.1.454.CMB.2.raw
  modified_base (234)..(234): a, c, t, g, unknown or other
  modified_base (556)..(557): a, c, t, g, unknown or other
  modified_base (559)..(561): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaacgccccaaattatcatttangaggccactaagcggccctcaggagtttctaatcgcttctctggctccaagtctggcagcacggcctccctgacaatctcgtgggctccgaggctggaggacgaggcctgattattactgctactcatatggacacatcaacaaactcccgtcttccggaccgtcgggacccgagggtcccacccggttccgtcggggtcacgaccccgaaacgggccccaaacccccgtactcgtcctaccttccgtccgttcccccgcccttcctccactcgtacacgtctcggacggccgggcgtcggaccgaaggcgaacacgtacgnncnnn

SEQ ID NO: 377458 - DNA, 552 bp, Homo sapiens
  misc_feature: GZ8MTXP02IB1IV.25.20.B09.1.454.CMB.2.raw
  modified_base (543)..(543): a, c, t, g, unknown or other
  modified_base (547)..(548): a, c, t, g, unknown or other
  modified_base (550)..(552): a, c, t, g, unknown or other
tcagactgtacagtcacgaccggtgctcgatttagtgtagtgtgaagggctggatgacttgggatgggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaagcccccaaattatcatttatgaggccactaagcggcctcaggtagttctaatcgcttctctggctccaagtctggcagcacggcctccctgacaatctcgtggctccaggctgaggacgaggcctgtattatactgactactcatatcgacacatcaacaaactcccgtcttcggaccgtcgggaaccgtagggtccaccgtccgtggggtcacgacccaacggccccaaaccctactcgtccaccttcctcgttccccgtccctcccttacaccgttacgtaccctagtccgtagacgtccggggactcgggacaagggccaacganacgnncnnn

SEQ ID NO: 377459 - DNA, 562 bp, Homo sapiens
  misc_feature: GZ8MTXP02FR8SD.25.20.B09.1.454.CMB.2.raw
  modified_base (296)..(296): a, c, t, g, unknown or other
  modified_base (311)..(311): a, c, t, g, unknown or other
  modified_base (443)..(443): a, c, t, g, unknown or other
  modified_base (484)..(484): a, c, t, g, unknown or other
  modified_base (505)..(505): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagccgtgggagtccctgagactctcctgtcagcctctgggttcatgtcagttcctctactatacactggggtcccnccacgcccccccggngaacggggctgggacgtggggtggctcgttatctcatatgataggaaatgttaaaatactacgccgactccgtgaaacgggcctattcgccgtctccaagagaaccaactaccaaagaactacggtgtttcngacaaactgaacgcctagaagaaatggtacggacaccggtnttagtaattactactgtcgcncgtactttcctcctcccttgcctcgcccctatcgtaacaactcgtcctcactctcgg

SEQ ID NO: 377460 - DNA, 518 bp, Homo sapiens
  misc_feature: GZ8MTXP02I64UR.25.20.B09.1.454.CMB.2.raw
  modified_base (425)..(425): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtctgggggaggcgtggtccagcctgggaggtccctgagactctcctgttcagcctctgggttcatgttcagttcctctactatacactgggtccgccagccccccggcaaggggcctgggagtgggtggctcgttatctcatatgatggaaatgttaaatactacgccgactccgtgaaagggccgattccgccgtctccagagacaactcaaagaacacggtnttctgcactgaacgctgagaatgtgacacggctgtatattactgtgcgcgtatttctctcctcgctcgcccactctacactctctcactctcg

SEQ ID NO: 377461 - DNA, 536 bp, Homo sapiens
  misc_feature: GZ8MTXP02I5V17.25.20.B09.1.454.CMB.2.raw
  modified_base (292)..(292): a, c, t, g, unknown or other
  modified_base (305)..(305): a, c, t, g, unknown or other
  modified_base (368)..(368): a, c, t, g, unknown or other
  modified_base (414)..(414): a, c, t, g, unknown or other
  modified_base (466)..(466): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctctttaagagatgtccagtgtcaagtgcacctggtggagtctgggggagcgtggtccagcctgggagtccctgagctctcctgttcagcctctgggttcatgttcagttcctctactatacactgggtccnccagccccccggnaaggggctggagtgggtggctcttatctcatatgatggaaatgtaaatctacgcgactccgtnaagggccattcgccgtctccagacgacaactcccaaagacacggtnttactgacactgaaacggcctagagaaatgaggacacggctagtataattcngtgcggtactatttcctctccctcggtacttcgcccctaactcctacgaacctcgtctaccattcctcgg

SEQ ID NO: 377462 - DNA, 684 bp, Homo sapiens
  misc_feature: GZ8MTXP02GO3V4.25.20.B09.1.454.CMB.2.raw
  modified_base (297)..(297): a, c, t, g, unknown or other
  modified_base (312)..(312): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtggggggagcgtggtccagccgtgggagtcctgagactctctgttcagcctcgtgggttcatgttcagttcctctactatacacgtgggtccnccgacgccccccggngaacgggctgggaggtgggtggctcgttatctacatatgtataggtaaatagttaaaactacctacgaccgtaacgtccggtaggaaacggggtcccgtagttcccgcccggtttaccacccaagaaacgaacctaaaccgtaacccgaaaacgaaacgttaaccgggttcgttttacacgacctaaaacgtacggaaaccggccttaagaaacgttaaagtcggttacgggaaccgtaaaccggtcgttaaggttaattaaagtttacctgggttacgaccggtacgtttacttttccgtcccttccccgttacggtcccttccgacccctaaccttaaccctaacgtaactctactacgtacttctacgg

SEQ ID NO: 377463 - DNA, 703 bp, Homo sapiens
  misc_feature: GZ8MTXP02H55U5.25.20.B09.1.454.CMB.2.raw
  modified_base (322)..(322): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagccgtggggacgtccctgagactctcctgttcagcctcgtggttcattgttcacgttcctctactataccacgtcggtcccgcccgaccggcccccccggngaacggggctcggggaggtcggggtcggtcctttacgttactctacaagttagtgaagttacggtaaaatttagttaaaactacgtaccggacccgtaacgtccgggtagggtaaacggggtcccgtagttcccgtcccgtactacccgaagtaacgaaccctaaacctaccgaaaacgaacgtaccgggtttactttacgacgaacctaacgtacggaaaccggtaccttaggaaagtaaagttacgggacgggaaccgtaaccggtctaaggtttaactaagtttcgtaggtcgtacggtcgttacttttccctccttcccgtccgtacctccgtacccctacttaacctaacctacttcgtctactacgttacgtcgg

SEQ ID NO: 377464 - DNA, 594 bp, Homo sapiens
  misc_feature: GZ8MTXP02FPWEP.25.20.B09.1.454.CMB.2.raw
  modified_base (308)..(308): a, c, t, g, unknown or other
  modified_base (325)..(325): a, c, t, g, unknown or other
  modified_base (433)..(433): a, c, t, g, unknown or other
  modified_base (516)..(516): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgcttcttttaagagatgtccagtgtcaagtgcaccgtggtggagtcgtgggggagcgtggtccaggccgtgggacgtccctgacgactctcctgtcagtcctcgtggttcattgttctagttcctctactactacacgtcgggtcccncccgacgcccccccggngaacggggctggaggtggtggcttcttatctcatatgatagaaaattagtaaaactacgtaccgccgactccggtaggaaacggggtccgtacgttcccgcgttaccnccgaaagacaaccaactaccgaaagaccgtacgttcgtttcagaccaaacgtcgaacgccgtaggaagagtgacgacgacgtntagtattagtcgtgtcgtcgtacttcttcctccctcgcctcgaccctctactaaccactactctcctctacgtctcgg

SEQ ID NO: 377465 - DNA, 602 bp, Homo sapiens
  misc_feature: GZ8MTXP02F0MD1.25.20.B09.1.454.CMB.2.raw
  modified_base (298)..(298): a, c, t, g, unknown or other
  modified_base (314)..(314): a, c, t, g, unknown or other
  modified_base (454)..(454): a, c, t, g, unknown or other
  modified_base (458)..(458): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgctcttttaagagatgtccagtgtcaagtgcacctggtggagtcgtgggggagcgtggtccagccgtgggagtccctgagactctcctgtcagcctgtggttcatgttcagttcctctactatacacgtcgggtcccnccaccggccccccggngaaggggctgggacggtgggtggctcttatcttacatatgtataggaaattgttaaaataccgtacgaccgtacttccggtagaaacggggccgtagttccgccgtctccaagacgaacaactaccaaagaactacggtnttcngacaacgtgaaccgtcagaagtaaatggtacggacacggtacttggtaattagttacgtaggtcgcggtcttatttccctcctccccttacggccttaccgcccctactaaccgtaacctaactcgtcctactactcgttacgg

SEQ ID NO: 377466 - DNA, 608 bp, Homo sapiens
  misc_feature: GZ8MTXP02GS0FP.25.20.B09.1.454.CMB.2.raw
  modified_base (295)..(295): a, c, t, g, unknown or other
  modified_base (310)..(310): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctggggttttcctcgttgctcttttaagagatgtccagtgtcaagtgcacctggtggagtctgggggagcgtggtcagcctgggagtccctgagactctcctgttcagcctctgggttcattgttcagttcctctactatacactgggtccncccacgccccccggngaacggggctgggagtgggtggcttcttatctcatagtgatcggtaaaatgttaaaatactacgccgtaactccggtaggaaacggggccgtacgttccgcccgtctacccagacgaacaactaccaaagaaccgtacggttcgtttctggacctaacgtcggaaacggtccgtaggaacgtaaaagtcgggtacggaacgacggtctaggtattaagttacgtgtacgccgtacgtactttcctcccttccctcggtccttccgccctactctacctaactctcctacactctacgg

SEQ ID NO: 377467 - DNA, 613 bp, Homo sapiens
  misc_feature: GZ8MTXP02HH2RE.25.20.B09.1.454.CMB.2.raw
  modified_base (388)..(388): a, c, t, g, unknown or other
  modified_base (584)..(584): a, c, t, g, unknown or other
  modified_base (605)..(605): a, c, t, g, unknown or other
  modified_base (607)..(608): a, c, t, g, unknown or other
  modified_base (610)..(610): a, c, t, g, unknown or other
  modified_base (612)..(613): a, c, t, g, unknown or other
tcagactgtacagtcacgaccggtgctcgatttagtgtagtgtgaagggctggatgacttgggatggggagagagacccctcccctgggatcctgcagctcctgcctccgtgtctgggtctcctggacagtcgatcaccatttcctgcactggactcagcactgatgttgctaggtttatttactttgtctcctggtaccaaacaacacccaggacaaacgacccccaaattatctatttatgagccaactaagccggccctcgaggtagtttctaatcgtcttctctggctccaagtctggcagcaccggccttccgtgacaatctcgtcggctccgaggctggaggacgaggcctagactttacttactcgacttactctaattancggtaacactaactacaaacctaaaccgttcccgttacgtttaccggaccgttacggggaacccgtacgggtaccgtaacccggttcgttcgggaccacggaccccgaacgggacccaaaccccgtcgtacgtacaccttcgtcccgttccccgtccctccctcctacgtcgaactcgttcgtacgcgtccgggcncggaccgaacggcgaacagcncnncncnn

SEQ ID NO: 377468 - DNA, 787 bp, Homo sapiens
  misc_feature: GZ8MTXP02I4GXT.25.20.B09.1.454.CMB.2.raw
  modified_base (320)..(320): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagccgtgggacgtccctgacgactctcctgtcagtcctctgggttcattgttctagttcctctactatacacgtcgggtcccgccgacggcccccccggngaacggggccgtagggacggttggggtcggtccttacgtttatcctcgtaaattagtaggtaagttaacggggtaaaaatttacggtttaaaaacttaccgttaaccggtaccccggtaacgttcccggggttaagggaaaccggggtccccgtaagtttcccgggtaccccgttcctacccgaaacgaacgaaaccctaaaaccgtacccgaaaaaggtaaacccgtaacgggtttcgtttaccgtacgtaaccgtaaacgttacgggaaacccgggtaccttaaagggaaacggtaaaagttcgggacgggtaaaccgacggttaccgttaggttaattacgtttaaccggtaggttcgaccggttacgtttactttttccctacccgttccccgtccggtccctacccgtacccctaaccttcctaaaaccgtaccttccgtcctacgtacttcgttaaccggg

SEQ ID NO: 377469 - DNA, 646 bp, Homo sapiens
  misc_feature: GZ8MTXP02H623G.25.20.B09.1.454.CMB.2.raw
  modified_base (294)..(294): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgcttcttttaagagatgtccagtgtcaagtgcactggtggagtcgtggggaggcgtggtcagccgtgggacgtcctgagactctctgtcagcctgtggtcatgtcacgttcctctactatacacgtcgggtccnccgacgccccccggagaacggggctggggaggtggggtggcttcgttatctctaatagtagtagtaaggtaaaattagttaaaactacgtaacggcccgtactccggtaggaaacgggccctagttccgcccgtctaccgaacgaacgaaaccaaacctaaccgaaacgaaaccgtacggttcgtttacgtacgaacctaacgtacggaaaccggacctaggtaaagtaaagttggacggaacgtacggtacgttagtaacttattaacgtggtacgtacgtcgtactttcctccgttcccgtcgtcctaccgaccctactaacctactaactctactactactcgtaccgg

SEQ ID NO: 377470 - DNA, 618 bp, Homo sapiens
  misc_feature: GZ8MTXP02I8RFQ.25.20.B09.1.454.CMB.2.raw
  modified_base (281)..(281): a, c, t, g, unknown or other
  modified_base (299)..(299): a, c, t, g, unknown or other
  modified_base (311)..(311): a, c, t, g, unknown or other
  modified_base (318)..(318): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatggtccagtgtcaagtgcacctggtggagtcgtgggggaggcgtggtccagcctggggaggtccctgagactctcctgttcagcctctgggttcatgttcagttcctntactatacactgggtccnccacgcccccgnaggggcnggagtgggtcggctcgttactctcattatgtataggaaaatgttaaaactactaccgaccgtactccggtgaaacggggtccgacgttccgacccgtcctcccgaagacgaccaaaccgtccaaagaaccgtacggttctttacgtgacaaacgtggtaaaccggccttagaaagaatgggtggaaccacggctaggttataacgtttatcggtgacgtacgttctttctcccgtccctacggtccctacgtcccctacgttcctaaccctaactttcggtacctactactccttacggg

SEQ ID NO: 377471 - DNA, 747 bp, Homo sapiens
  misc_feature: GZ8MTXP02HGFYR.25.20.B09.1.454.CMB.2.raw
  modified_base (320)..(320): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcaccgtggtggagtcgtgggggaggcgtggtccaggccgtgggacggtccctgacgacttctcctgttcagtcccttcgtagggttcattcgttcagtttccctactactatacctacgttcggggtcccnccccaccggcccccccgggagaacggggtctgggaggtggggtcggcttccttagtcctcgtaattatggtagtaacgggtaaaatttacggttaaaaactaccgttaacggccccgaacgttcccgggtagggaaacggggtcccgtaatttccccgggacctacctacccgaaagaccgaaacctaaacctaacccgaaacgtaaacccgtacgggtttaccgttacgtacgtaccgaaacgtacggaaccggtaccgtaggaaggtaaagtagggtacgggaaccgaccggtacttaggttaacttaatttaccgtggtacgtcgtacggttacttttccctccgttccccgtcgtcccgttacccgaccccttaacctaaccgtacctaaaccgtttctaacccttcaacgtttcgtaccggg

SEQ ID NO: 377472 - DNA, 794 bp, Homo sapiens
  misc_feature: GZ8MTXP02I8V8Q.25.20.B09.1.454.CMB.2.raw
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgcttcttttaagagatgtccagtgtcaagtgcacctggtggagtcgtgggggagcgtggtccagcctgggagtcctgagactctcctgttcagtcctcgtggttcattgttcacgttcctctactatacaccgtgggtcccaccaccggccccccggagtaacggggctagggaggtcggggtgtccttacgtttatccttacaaattagtaggtaacgtaacggtaaaattaggtttaaaaactacccgttaacgccccgtaacgtttccgggagggaaaccggggtacctaacgtttcccgggacccgttaccgtacccaaagggaacgtaaaccctaaacctaacccggaaaaaggaaaaccgttacggggtttcttttacgacggaacaaaccggttacggaaacccggggtaccttagggaaaacggtaaaacgttgggtacggggtaaaccgaccgggtaccgtttagttaaagtttaaacctttacgttgggttacgccggttaacgtttactttttccctaccccggttcccttaaacggtcccgtttcccgacccccttaaaacttaacccggttaaaaccctaaaacgtttccgtaacctttaccctaccgtttacggttacgg

SEQ ID NO: 377473 - DNA, 709 bp, Homo sapiens
  misc_feature: GZ8MTXP02GKUYL.25.20.B09.1.454.CMB.2.raw
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgcttcttttaagagatgtccagtgtcaagtgcaccgtggtggagtcggtgggggaggcggtggtccaggccgtgggacggtcctgacgactctctgtcagtcctcgtgggttcattcgtctacgttcctctactatacacgtcgggtccgcccgaccggccccccggaggaacggggcgtgggaggtggggtcggtcttcgtatctactatatagataaggtaaattagttaaactacgtacgaccgacgtcgggtagacgggccgtagttccgtccgtactcccgaagacgaaacctaactaaccgaaaggtaaacccgtaggtttccgtttacgacgtaacctaaacgtacggaaaccggtaccgtaagaaggtaaaagtgggtacggaaccggtacggtaacttacggttaatttacgttaacgtcggacggtacccggtactttacgtttccccttccgttccccctacggttccctaccggaccccttacccgtaacgttaaccctaaacgttcgttacctcctaacctttcggtaacccgggg

SEQ ID NO: 377474 - DNA, 634 bp, Homo sapiens
  misc_feature: GZ8MTXP02JRAOB.25.20.B09.1.454.CMB.2.raw
  modified_base (303)..(303): a, c, t, g, unknown or other
  modified_base (318)..(318): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgctcttttaagagatgtccagtgtcaagtgcaccgtggtggagtcgtgggggagcgtggtccaggccgtgggaggtccctgagactctcctgttcagcctcgtggttcattgttcagttcctctactatacacgtcgggtccnccgacgccccccggngaacggggctgggaggtggggtcggtcttcgttatctctaatatagtataggaaattagttaaaactacgtacgaccgactccggtaggaaacgggccgtagttccgccgtcctaccaagacgtaacccaaactaccaaagtaaaccgtacggttcgtttacgtgaccgaaacgttacggtaaaccgggtccctagggaaacgtaaagtggtacgggacgacgtcgtagttaattacgttacgtgtcgcgtcgtactttcctcctccctcgcctccgaccctactctacctacgttcgtactactagtcgtaacgg

SEQ ID NO: 377475 - DNA, 687 bp, Homo sapiens
  misc_feature: GZ8MTXP02JGS8B.25.20.B09.1.454.CMB.2.raw
  modified_base (238)..(238): a, c, t, g, unknown or other
  modified_base (282)..(282): a, c, t, g, unknown or other
  modified_base (319)..(319): a, c, t, g, unknown or other
  modified_base (670)..(670): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgcttcttttaagagatgtccagtgtcaagtgcaccgtggtggagtcgtgggggagcgtggtccagcctgggacgtccngagactctcctgttcacgtcctcgtggttcatgtctagttcctntactactacacgtcggtcccgccgccggccccccggngaaacgggcgtggaggtggtggtcttcgttagtccttcatagtgaagtacggtaaaattagttaaactaccgttaccggacccgtacgtccggtaaggtaacgggtcccgtagttcgccgtcgtacccaaggacaacccaaaccgtaccgaaaagaacccgtacggttacgttacgtcgaacctaacgtagaaacccgggtccttaaagggaactaaaagtccgggtacggaaccgtaaccgggttattagttaattaacgttaccgtggtacgaccgttacgttctttcccaccgttcccctacggtacctcccgaccctacgtaacccgttaacctaccgtcgttaccncgttaccgtaccgtacg

SEQ ID NO: 377476 - DNA, 648 bp, Homo sapiens
  misc_feature: GZ8MTXP02F90QJ.25.20.B09.1.454.CMB.2.raw
  modified_base (256)..(256): a, c, t, g, unknown or other
  modified_base (302)..(302): a, c, t, g, unknown or other
  modified_base (319)..(319): a, c, t, g, unknown or other
  modified_base (570)..(570): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagcttgggttttcctcgttgcttcttttaagagatgtccagtgtcaagtgcaccgtggtggagtcgtgggggagcgtggtccagccgtgggacgtcctgacgactctcctgttcngtcctgtggtcattgtctgttcctctactatacgactcgggtcccnccgaccggccccccggngaacggggcctgggaggtcggggtggccttacgttacgtcgttacattagtagagtacggtaaattagtaaataccgtacgccgtacgtccggtagggaaccggtaccgtacgttcccgcccgtacgtaccgaacgaacgaaaccctaacgaacccaaaggtaacccgttacggttagtttcaacggacctaaacgtcggaaacgttacgagaaagtaacgtgtacggacacggtcttagtactattacgngtacgctacgtactttccgtctccctcgtcctaccgccctaacgtcctaaactcgttacgtctactacgtctaccggg

SEQ ID NO: 377477 - DNA, 753 bp, Homo sapiens
  misc_feature: GZ8MTXP02HZ446.25.20.B09.1.454.CMB.2.raw
  modified_base (257)..(257): a, c, t, g, unknown or other
  modified_base (302)..(302): a, c, t, g, unknown or other
  modified_base (678)..(678): a, c, t, g, unknown or other
tcagactgtacagtcacgaccggtgctcgatttagtgtagtgtgaaggggtctgggagacgagcccagcactggaagtcgccggtgtttccattcggtgatcatcactgaacacagaggactcaccatggagtttgggctgagctgggttttcctcgttgctcttttaagagatgtccagtgtcaagtgcacctggtggagtcgtgggggagcgtggtccagcctgggaggtccctgagactctcctgttcagcctntgggttcattgttcagttcctctactataccactggggtaccccnccgaccggcccccggaggacggggctaggggtaggtcggggtggtcctttacgtttatcgtactaagttagtagtaagttaacggtaaaatttacgtttaaaaacgttacccgtaaccgggtaccccgttaaccgttccggggtaacgggaaaccgggggtacccgttacgtttcccggcccgtaccgtacccaaacggtacgaaaccctaaaccgtaacccgaaaacgtaaaccgtacggtttcgtttacctacggtaaccgtaacgtacggaaaccggtccgtaaaggtaaaggtaaagttgggtaacgggaccgtaacggtcgttagttaacgttaagtttacgtggtacgtcggttaccgtacgttttcccnccgttccccgtcgtccgtccgtaacccctacttaacccgtaaaccgtacgttcgttaccctcgtacttacggtcg

SEQ ID NO: 377478 - DNA, 470 bp, Homo sapiens
  misc_feature: GZ8MTXP01C0MRF.52.14.B03.1.454.CMB.2.raw
  modified_base (153)..(153): a, c, t, g, unknown or other
  modified_base (364)..(364): a, c, t, g, unknown or other
  modified_base (465)..(470): a, c, t, g, unknown or other
tcagcgcagtacgacacgaccggtgctcgatttagtgtgagtagttccgcgggtcagaatattaataagtggttggcctggtatcagcagataccagggaaagcccctaaactcctgatctataaggcgtctagtttagaagtgggtcccttnaaggttcagcggcagtggatctgggacagaattcactctcaccatcaaacagcctgcagcctgatgtattttgactaacttattactgaccaaactactaataatactatttacttcctacccggtcctacgtttccggcccgtagggaccctaagtctaagactagtaccggaacgtaacgttggtcgggcctacggaccctaaaccctntttccgttgtttccctttaccacgttcccctttaccccgacctagttcctagtactatacgatcgcttaggcgggcggcgtggacgaacgggtcacagtannnnnn

SEQ ID NO: 377479 - DNA, 377 bp, Homo sapiens
  misc_feature: GZ8MTXP02F8XF2.52.14.B03.1.454.CMB.2.raw
  modified_base (354)..(354): a, c, t, g, unknown or other
  modified_base (372)..(372): a, c, t, g, unknown or other
  modified_base (375)..(377): a, c, t, g, unknown or other
tcagcgcagtacgacacgaccggtgctcgatttagtgtgagtagttccgcgggtcagaatattaataagtggttggcctggtatcagcagataccagggaaagccccctaaactcctgatctataaggcgtctagtttagaaagtgggtcccttcaaggttcagcggcagtggatctgggacagaattcactctcaccatcaacagcctgcagcctgatgattttgcaacttattactgccaacactataatcattatctccggcactttcggccctggaccaagctagatatcggacgaactgtggctgcaccatctgtcttcatcctcccgcatctgatatacgatcgctgngcgggctggcaaggcganatnnn

SEQ ID NO: 377480 - DNA, 552 bp, Homo sapiens
  misc_feature: GZ8MTXP01EFT9L.51.86.H09.1.454.CMB.2.raw
  modified_base (389)..(389): a, c, t, g, unknown or other
  modified_base (427)..(427): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactacttgaattggttcagcagaggccaggccaaatctccaagacgcctaatttataaggtttctaacgggactctgggtcccagacagattcagcgcaagtgggtcaggcactgatttcacactgataatcganagggtgaggcgtgagagtgttggtttagttacgtggtntatagacgaagtacgacacgtcggcgtcgggtacggttcggccggaacgggaaccgaaagggtaaggaaagtaacgtaaacgaaacgttagttaggaacgtggcgacacttactcgttcgtttcc

SEQ ID NO: 377481 - DNA, 562 bp, Homo sapiens
  misc_feature: GZ8MTXP01EQV78.51.86.H09.1.454.CMB.2.raw
  modified_base (426)..(426): a, c, t, g, unknown or other
  modified_base (428)..(428): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatactctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaaagacgcctaaatttataaggtttctaacgggactctggggtcccagacagattcagcggcagtggtcaaggcaactgatttcacactgataatcgacagggtgagctgaggagtgttggtttagttatgtananggagaagtacacacgtcgcgtcggtacggtcggtaccgaacggaacggaaggtaaggtaaagttaacgtaaacgaaacgtacgtacggcgttcgacgaacctactcgtcgttcgttactaacgttccgttcccg

SEQ ID NO: 377482 - DNA, 570 bp, Homo sapiens
  misc_feature: GZ8MTXP01BEGWY.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactacttgaattggttcagcagagccaggccaaatctcaagacgacctaaatttataaggtttctaaccgggtactcgtgggggtcccaggacagattcgagcggcaagtgggtcagggcactgatttcacactgataatcgacgaggggtgaaggtctgaggtatggtttgggtttatacgtggcgtagtgacgaaaggttacacgtacgtggtccgtggggaccgttcggccgaaagggaccttaaagggtacggaaacgtacgaaaacgttaacgttggttacggctagcctaccattctcgttctttaaccg

SEQ ID NO: 377483 - DNA, 554 bp, Homo sapiens
  misc_feature: GZ8MTXP01DBB8B.51.86.H09.1.454.CMB.2.raw
  modified_base (385)..(385): a, c, t, g, unknown or other
  modified_base (540)..(540): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccaggtggggatgttgtgctgactcagtctccactctccctgcccgtcacccttggacagccgcctcatctcctgcaggtctagtcaagcctctatatagtgatagaaacactatgaattgtcagcagagccaggccaatctacaagacgacctaaatttataaacggtttctaaaccgggtacttcgtcgggggtacccagacagacttccgaggcggcaggtgggtacagggcactgatttcanactgaataatcgacgaggggtgaggctaggaggtatggtttggtttatactgcagtgacgaaggtacagacgtggccgtaggggacgttcggaccgaaagggaacgaaaggtagaaataacgaaaacgtaacgtgttcggcttgcacctaatctnttcttcaacttccc

SEQ ID NO: 377484 - DNA, 560 bp, Homo sapiens
  misc_feature: GZ8MTXP01DAS9S.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctcctatatagtgatggaaacacctacttgaattggttcagcagaggccaggcccaaatctaccaaagacgtccttaaatttataaaggtttctaaaccgggactcgtgggtacccagacagattcagcgcaaggtgggtcagggcactgatttcacactgataatcgacgagggtggagctgaggtatgttggtttatactgggctattcgaaagtacatacgtggcctgggtacgttcggaccgtaaaggggaaccaagggttagaaattcgtaaaacgaacgttggttggcgttggacaacccattcgttcgtccttcgtaacc

SEQ ID NO: 377485 - DNA, 531 bp, Homo sapiens
  misc_feature: GZ8MTXP01D10KC.51.86.H09.1.454.CMB.2.raw
  modified_base (186)..(186): a, c, t, g, unknown or other
  modified_base (240)..(240): a, c, t, g, unknown or other
  modified_base (249)..(249): a, c, t, g, unknown or other
  modified_base (267)..(267): a, c, t, g, unknown or other
  modified_base (285)..(285): a, c, t, g, unknown or other
  modified_base (292)..(292): a, c, t, g, unknown or other
  modified_base (397)..(397): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtgggatgttgtgctgactcagtctccactctcctgcccgtnacccttggacagccgctcatctcctgcaggtctagtcaaggcctctatatagtnatggaaacnctatgaattgtcagcagngccagccaatctacagcnctaattnaaggttcaacggctgtgggtccagacagattcagcgcaagtggtcaggcactgattcacactgataagtcgacagggtgagctaggagtattgttaggttatcgnggctagtcgactaaaggtcacgtacgtcggtcctggggaaccttcggacgtaacgggtacaaggttggaaacgtcgaaacgttaacgttgacgggtaactcggtaaccacgtagttacgttcggttcttaaccg

SEQ ID NO: 377486 - DNA, 543 bp, Homo sapiens
  misc_feature: GZ8MTXP01EHAWM.51.86.H09.1.454.CMB.2.raw
  modified_base (452)..(452): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggtcagcagagccaggccaatctaccaaagacgaccttaaatttataaggtttctaaaccgggactcgtgggggtcccagacagattccaggcggcaggtgggtacagggcactgatttcacactgataatcgacgagggtgaggctaggaggtatggttgggtttatactgcagtgacaaggtacanacgtggccgtagggacgttcggacaagggaccaaaggtggaaatcgaaaacgaactggttaggcttgcacaattctgttctcttaagtccc

SEQ ID NO: 377487 - DNA, 513 bp, Homo sapiens
  misc_feature: GZ8MTXP01AWSVP.51.86.H09.1.454.CMB.2.raw
  modified_base (509)..(509): a, c, t, g, unknown or other
tcagcgatcgtatacacgaccggtgctcgatttagtgctatagacttgggtttgggatcaggactcctcagttcaccttctcacaatgaggctccctgctcagctcctggggctgctaatgctctgggtcccaggttccagtgggatgttgtgctgactcagtctccactctccctgcccgtcacccttggacagccggcctccatctcctgcaggtctagtcaaggcctctatatagtgatggaaacacctactgaattggttcagcagaggccaggccaatctccaagacgcctaaatttataaggtttctaaccgggactctgggggtcccagacagattccagcggcagtggtcagggcactgatttcacactgataatcgacagggtgagctgaggatgttgggtttatactgcagtgcaaggtacacactggccgtgggacgttcggcaagggaccaaggtggaaatcaaacgactagttggcttgcaccaatctgttcttcnttcc

SEQ ID NO: 377488 - DNA, 552 bp, Homo sapiens
  misc_feature: GZ8MTXP01A6TZU.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctactgaattggtcagcagaggccaggccaatctccaagacgcctaatttataaggtttctaaccgggactcgtggggtcccagacagattccagcggcagtgggtcaggcactgatttcacactgataatcgacagggtgaggcgtgagtagtgttggtttagttactgtcagtgtcgaaggtacgacaacgtcggccgtcgggtacggtcggtaccgaacgggaaccgaaggtaggaaagtaacgaaacgaaacgtagttaggcgttgcacaactctcgttcttcgttaacttcccg

SEQ ID NO: 377489 - DNA, 567 bp, Homo sapiens
  misc_feature: GZ8MTXP01BTYHX.51.86.H09.1.454.CMB.2.raw
  modified_base (252)..(252): a, c, t, g, unknown or other
  modified_base (270)..(270): a, c, t, g, unknown or other
  modified_base (396)..(396): a, c, t, g, unknown or other
  modified_base (548)..(548): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagcccggcctccatctcctgcaggtctagtcaaggcctctatatagtgatgaaacnctattgattgtcagcagngcagccaatcaccaagacactaatttataagtttcaaccggactcgtcgggtccagacagtattccagcggcaggtcggtacaagggcactgtatttcaacactgaataatcgacgagggtggagntagaggtatgtttcgggttatactgcagttagacgtaaaggtacacgtaccgtgggtaccgtaggggtaccgttcgggaccgtaaacggggacctaaagggtagaaaacgttacgaaaacggtaaactggttaggcttagccacaattcgtnttaccttcgaacgttcccg

SEQ ID NO: 377490 - DNA, 709 bp, Homo sapiens
  misc_feature: GZ8MTXP01CYOCY.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaactacctacttgtaattggttacagcaggacggccaggccaatcctaccaaagaccgtacctttaaatttaagttaacggtttaccgtaaaccgggtactttcggtcgggggtaccccagaacagtacttaccgacggcggcgtagggttcgggtaacccagggtcctaacgtgtaacttttccgaactacgttagtaaacttaaacgtaccggaacggtaagggggttgggaacgggtcgtagggtaaggggttagtttgggtttttacggggttttaattacgtggtacgtaggttacggacgtaaagggtaccaacgtacgttcgggccgttagggggtacccgtttcgggaccgaaaggggaacccgtaaaggggtaacggaaataccgaaaacggtaaacgtggttacggcttacggcctaaacctgttcgtcgttaccttcgttaacttcccg

SEQ ID NO: 377491 - DNA, 664 bp, Homo sapiens
  misc_feature: GZ8MTXP01EF3KY.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctattgaattggttcagcagaggccaggccaaatctaccaagacgacctaaatttataaggtttctaaacgggactcgtggggtcccagacagattcagcggcaaggtgggtcagggcactgatttcactactagataatcgacgagggtggagctaggaggtattggtttagggttttaattacgtgggtactagttacgacgtaaagggttaccaacgtaacgtttcggggcccgttacgggggtaaccggtttccggggaacccggtaaaacggggaaccccgttaaaagggggtaaggggttaaaaacgttaaaccggaaaaaccggttaaaccgttgggttacggggaaccttacgggtaacccgaacccgtaatttaccggtttccgtttccgtttaacccg

SEQ ID NO: 377492 - DNA, 535 bp, Homo sapiens
  misc_feature: GZ8MTXP01ANPAL.51.86.H09.1.454.CMB.2.raw
  modified_base (443)..(444): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggtttcagcagaggccaggccaaatctaccaagacgcctaaatttataaggtttcaaaccggggactcgtcggggtcccagacagattcagcgcagtgggcaggcactgatttcacactgataatcgacagggtggagcgtgagagtggttggtttagttatgnngtgagaagacacacgtcgcgtggtcgttcggacggaacggaacgaaggaggaacgacgaaacgaacgtaacgtggcgcgtcgaacgtaacg

SEQ ID NO: 377493 - DNA, 586 bp, Homo sapiens
  misc_feature: GZ8MTXP01B0902.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctattgaattggttcagcagaggccaggccaatctaccaagaccgtaccttaaattttagtaacggtttcctaaaccggggtctcgtcgggggtacccagacagacttcgaggcggcaagggtgggtcagggcacgtgtactttcgacactgataagtcgacgagggtggaggctaggaggtattggtttagggttttatacgtggctagtcgacgaaaggtacacgtacgttcgggcccgttggggaccgttacggaccgaaaggggaccgaaagggtacggaaactacgaaacgacgttggacggctgaaccacgattctcgttcttc

SEQ ID NO: 377494 - DNA, 618 bp, Homo sapiens
  misc_feature: GZ8MTXP01CURN9.51.86.H09.1.454.CMB.2.raw
  modified_base (276)..(276): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgatggaaacacctattgaattggttcagcagngccagccaatctacaagacacttaaatttataaggtttctaaccgggctcgtcggggtacccagacagacttcaggtcggactaaggtgggtcagggcaacgtgtaatttcaactactagtaataaacgtcggagtagggggtggaagggtcgtaggagggtagttggtttaggggttttaacttacgtagggtctaagttcgaacgtaaaggttaaccacgtacgtacgggtccgtaggggtacggttccggaccggaaacggggaaccgttaaaggggttaacggaaattaaccgaaacggaacgttggttacggctacggctaccgattctcgttcttc

SEQ ID NO: 377495 - DNA, 541 bp, Homo sapiens
  misc_feature: GZ8MTXP01DMAK0.51.86.H09.1.454.CMB.2.raw
  modified_base (374)..(374): a, c, t, g, unknown or other
  modified_base (382)..(382): a, c, t, g, unknown or other
  modified_base (396)..(396): a, c, t, g, unknown or other
tcagcgatcgtatacacgaccggtgctcgatttagtgctatagactttgggtttgggggatcaggactcctcagttcaccttctcacaatgaggctccctgctcagctcctggggctgctaatgctctgggtcccaggttccagtggggatgttgtgctgactcagtctccactctccctgccccgtcacccttggacagcccggcctccatctcctgcaggtcagtcaaggcctctatatagtgatggaaacacctacttgaattggtcagcagaggcaggccaatctcaagacgcctaatttataaggtttctaacgggctcgtggggtcccagacagattccagcggcagtgggtcaggcactgatttcanactgatancgacagggtggagntaggagtatggttgggtttatacgtgcagtgcgaaggtacacgacgtcggcgttagggcgttacggaccgaacgggaccgaagggttaggaaactacgaaacgacgtgttaggcttgcacctaatctgttctttccgaattcccg

SEQ ID NO: 377496 - DNA, 536 bp, Homo sapiens
  misc_feature: GZ8MTXP01CXVFG.51.86.H09.1.454.CMB.2.raw
  modified_base (256)..(256): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacnctattgaattggttcagcagaggccaggccaatctcaagacgacctaatttataaggtttctaacgggactcgtgggtcccagacagattcagcggcaagtgggtcaggcactgatttcacactgataatcgacgagggtgaggctgaggtattgttggtttatacgtggcatgacaaggtcactacgtcggctaggggacgttcggacgaaagggaccaagggtacggaaatacgaaacgaacgttggttacggctggccaccgattctgttcttaacc

SEQ ID NO: 377497 - DNA, 596 bp, Homo sapiens
  misc_feature: GZ8MTXP01EBAWN.51.86.H09.1.454.CMB.2.raw
  modified_base (253)..(253): a, c, t, g, unknown or other
  modified_base (407)..(407): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatggaaacnctacttgaattggttcagcagaggccaggccaaatctaccaagacgtacctaaatttataaggtttctaacgggctcgtgggtcccagacacgatcagcgcaagtgggtcaggcactgatttcatactgataatcgacagggtgaggctggagngttgtttgggtttattacgtgggactagtgactaaggtacacgtacgtagggccgttaggggaccgttccgggcccgtaaaagggggtacccaaaagggtaacgggttaaaacttaccgaaaaacggttaaccgttggttacgggcttaggaacctaacccgtattcccgtttggttccgttttaaccg

SEQ ID NO: 377498 - DNA, 613 bp, Homo sapiens
  misc_feature: GZ8MTXP01BZGIB.51.86.H09.1.454.CMB.2.raw
  modified_base (267)..(267): a, c, t, g, unknown or other
  modified_base (414)..(414): a, c, t, g, unknown or other
tcagcgatcgtatacacgaccggtgctcgatttagtgctatagacttgggtttgggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacnctacttgaattggttcagcagaggccaggccaatctacaagacacttaatttataggttcaacggactcgtcgggtaccagacagattcagcggcagtgggtcaggcactgatttcacactgataaagtcgaacgaggggtggaggngtaggtaggtagtttgggggttttagggtttttaattacgtgtacgtagtacggaacgtaaacggtacctaaccgtaccggtcgggtaccggttaacggggtaccggttaccgggaaccggttaaacgggaaaccgtaaaggggttaacggttaaacgttaacgaaaacggtacgtggtggcttacgtccaaccgtaag

SEQ ID NO: 377499 - DNA, 556 bp, Homo sapiens
  misc_feature: GZ8MTXP01E1BSE.51.86.H09.1.454.CMB.2.raw
  modified_base (255)..(255): a, c, t, g, unknown or other
  modified_base (399)..(399): a, c, t, g, unknown or other
  modified_base (545)..(545): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctacttgaattggttcagcagagccaggccaatctcaagacgccttaaatttataaggtttcaaccgggtctcgtcgggtcccagacagattcagcggcaaggtgggtcagggcactgtactttcactactgaataatcgganaggggtggaggctggaggtattggtttaggtttatactgggctagtgacgaaggtacacgtacgtgggcccgtggggtacgttaccgggcgaaacggggaccgaaagggtaggaaatacgaaaacgacgttggttgctggcaccgnttctgttcttc

SEQ ID NO: 377500 - DNA, 535 bp, Homo sapiens
  misc_feature: GZ8MTXP01CE3OI.51.86.H09.1.454.CMB.2.raw
  modified_base (395)..(395): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaaatctccaagacgcctaatttataaggtttctaacgggactctggggtcccagacagattcagcggcaagtgggtcagggcactgatttcacactgataatcganagggtgaggctgagattgttggtttattactggcagtgacaaggtacacacgtggcctggggacgttcgggccgaaagggccgaaagggtcggaaagtacgaaacgacgttggttggctgcaccgattcctgttcttaac

SEQ ID NO: 377501 - DNA, 599 bp, Homo sapiens
  misc_feature: GZ8MTXP01DB5BX.51.86.H09.1.454.CMB.2.raw
  modified_base (254)..(254): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgatggaaacnctacttgaattggttcagcagacggccaggccaaatctaccaaagaccgtaccttaaatttataacggttttctaaaccggggacttacgtgggggtaccccagacagattcgagcggcaagtgggtcagggcacgtgattcacactgaataagtcgacgagggtggagctgaggattgttgggtttaattacgtggactagtgactaaggtacacgacgtgggcctggggaccgttcgggaccgaaaggggaccgaaagggttgaaaagttaccgaaaacggacgttggttacgggaaccttacggaacctaaccctagttacctttcggttccgtttaacccg

SEQ ID NO: 377502 - DNA, 545 bp, Homo sapiens
  misc_feature: GZ8MTXP01DR1ZS.51.86.H09.1.454.CMB.2.raw
  modified_base (253)..(253): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatggaaacnctattgaattggttcagcagagccaggccaatctcaagacgaccttaaatttataaggtttctaaccgggactcgtggggtcccagacagattcagcggcaagggtgggtcaggcactgatttcacactgaataatcgacgagggtggaggctaggaggtattgtttgggtttatacgtggctatgacgaaggtacacgagtcggcgtggggacgttcgggacgaaagggaccgaagggtaggaaatacgaaacgaacgttggacggctagcaccattcttgttctttaacc

SEQ ID NO: 377503 - DNA, 528 bp, Homo sapiens
  misc_feature: GZ8MTXP01CERUA.51.86.H09.1.454.CMB.2.raw
  modified_base (424)..(424): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctccccgtcacccttggacagccggcctccatctcctgcaggtctagtcaaggcctctatatagtgatggaaacacctacttgaatggttcagcagaggccaggccaatctccaaagacgacctaaatttataaggtttctaaaccgggactcgtgggtcccagacagacttcagcgcagtgggtcaaggcactgatttcacactgataatgacagggtgagctgagatgttggtttatactgnatgacaaggtacacgagtggaccgtgggtaccgttcggcaaagggaaccaaaggttggaaaattcgaaaacgattgttggactgacaacatcttgtcttctaac

SEQ ID NO: 377504 - DNA, 560 bp, Homo sapiens
  misc_feature: GZ8MTXP01AIX7M.51.86.H09.1.454.CMB.2.raw
  modified_base (383)..(383): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctattgaattggttcagcagaggccaggccaatctccaaagacgtcctaaatttataaggtttcaaccggggactcgtggggtcccagacagattcgagcggcaagtgggtcagggcactgattcanactgataatcgacgagggtggaggctaggagtagttggtttagggtttattacgtggggctagtgacaaaggtacacgacgtgggccgtgggggacgttcgggaccgaaagggaccgaaagggtaggaaataccgaaaacgttacgttggttcggctgccaccattctgttcttaac

SEQ ID NO: 377505 - DNA, 575 bp, Homo sapiens
  misc_feature: GZ8MTXP01B351D.51.86.H09.1.454.CMB.2.raw
  modified_base (245)..(245): a, c, t, g, unknown or other
  modified_base (254)..(254): a, c, t, g, unknown or other
  modified_base (269)..(270): a, c, t, g, unknown or other
  modified_base (416)..(416): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtnatggaaacnctacttgatgttcannagagcagcatctccagacgcctaatttaattaaggtttacgttaaccggacgtctcgggtccgacgacagattcagacggcgaagtgggtcgaggacactagtattactacaactgtaataaagtcgacgaagggtgggaacgggngtagagggtattcgtttagggttttattacgtggagtagtagacgaacggtacacgacgtcgggtccgtacggggtacgtacggcgaaacgggaacgttaaaggtaaggaaataaaccgaacgacgttgttcggctacgctacctattcgttcgttctc

SEQ ID NO: 377506 - DNA, 629 bp, Homo sapiens
  misc_feature: GZ8MTXP01COR0O.51.86.H09.1.454.CMB.2.raw
  modified_base (253)..(253): a, c, t, g, unknown or other
  modified_base (599)..(599): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatggaaacnctattgaattggttcagcagaggccaggccaatctaccaagacgtaccttaaatttataaaggttttacctaaccggggacttcgtgggggtaccccaagaccgaagtattcgaaggcggacaaaggttggggtccaaagggtccaaacgttggactttacaacgacttagaataaagtcgaacgaggggtggaagcgtagagggtatgtttcgggtttaattactgggactaagtgacgaaaggtcaacgcgttacgggccgttggggtacgttaccggaccgaaaagggggacccaaagggttaggaaacttaacggaaaaccgttacgttcgggagtaacggngtaaccacccgtattccgttgttccttaac

SEQ ID NO: 377507 - DNA, 626 bp, Homo sapiens
  misc_feature: GZ8MTXP01ANBN8.51.86.H09.1.454.CMB.2.raw
  modified_base (269)..(270): a, c, t, g, unknown or other
  modified_base (289)..(289): a, c, t, g, unknown or other
  modified_base (324)..(324): a, c, t, g, unknown or other
  modified_base (437)..(437): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgatggaacactacttgatagttgannagagcgagcatctcagacnctaattatagttactacggacgtctggtccacganacgattcaggcggtcaaggtgggtcgaggacgactacgtatttacacaactgtataaagtaccgagaggggttaggaggcgtgagggaattgggtttagggttttatttaacnggggactagtagtacgaaacggttacacgaacgttgggtacccgtcgggggtaaccggtttcgggaccccggaaaaggggaacccgaaaggggttaaacgggttaaacttaaaaccgaaaacggttaccggttagttcgggggccttacggtaaccaacccgtagttacgttcggttccgttttaaccc

SEQ ID NO: 377508 - DNA, 566 bp, Homo sapiens
  misc_feature: GZ8MTXP01C6R55.51.86.H09.1.454.CMB.2.raw
  modified_base (254)..(254): a, c, t, g, unknown or other
  modified_base (443)..(443): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgatggaaacncctattgaattggttcagcagagccaggccaatctacaagacgacttaaatttataaggtttctaaaccgggctcgtggggtcccagacagatcagcgctaaaggtgggtcagggctacgtgtattcaacactagaataagtcgagagggtggagtgtagaggtattggttacggtttaatacgtggtntagtgaacgaaggtacacgtcgtacggcgtaggggtacgtcggacgtaaagggaccaaagggttagaaagttaaccgaaaagacgttgggttacggctacgctaccgattcctgttcttaacc

SEQ ID NO: 377509 - DNA, 631 bp, Homo sapiens
  misc_feature: GZ8MTXP01CXDML.51.86.H09.1.454.CMB.2.raw
  modified_base (252)..(252): a, c, t, g, unknown or other
  modified_base (273)..(273): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctcctgccctcacccttggacagccggcctccatctcctgcaggtctagtcaaggcctctatatagtgatggaaacncctattgaaattggtttcagnagagcacgacaatactacaacgacgactaattaattaagtttacgtaaccggacgtcgtcgggtccgacgacgacgtatacgagcggcgaaggtagggtcgacggacgactacgtattactacactagtataaatacgacgagggtaggacgacggacgtaggaggtagttaggtttagggttttaagtttaacggttacgtacgtagtacgtacgtaaacgtaacgaacgtaacgtcggtccgtacgggtacgggtcggtaaccggaacgggaaacggtaaacggttaaacgggtaaacgtaaacgttaaacgaaacgttaacgtaacggtacgtcgcgtacacctaacgttcgtcg

SEQ ID NO: 377510 - DNA, 692 bp, Homo sapiens
  misc_feature: GZ8MTXP01EDJWI.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacacgccggcctccatctcctgcaggtctagtcaaggcctctatatagtgatggaaacactacttgaattggttcagcagacggccaggccaatcctaccaaagaccgtaccttaaattttagttaacggtttacctaaaccggggacttcggtacgggggtacccaaggactaacgtattacgaggccggcgtaaagggttcggggtcagggcctactgtactttcactactagaataagtcggacgaggggtggaaggcgtaggaggtagttgggtttagggttttaattacgttgggtactagttacggacgtaaacgggtaaccacgtacgttacggggccgttgggggaccggtttccgggaaccggaaaacggggtaaccggttaaaggggtaacgggttaaaaagttacccggaaaaacggttaccggttgggttacgggccgttacggaacctaacccgtatttccgttcggtttccctttaacccg

SEQ ID NO: 377511 - DNA, 546 bp, Homo sapiens
  misc_feature: GZ8MTXP01B5HKL.51.86.H09.1.454.CMB.2.raw
  modified_base (406)..(406): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaaatctccaagacgcctaaatttataaggtttctaacggactctggggtcccagacagattcagcggcaagtgggtcaggcactgatttcactactgataatcgacgagggtggaggntggaggtatgttgggtttattacgtggctagtgacgaaaggtcacgacgtcggccgtgggaccgttcggacccgaaagggaacccgttaagggtacggaaagtaacgaaagacgttgttggctgcaccattctgttcttc

SEQ ID NO: 377512 - DNA, 547 bp, Homo sapiens
  misc_feature: GZ8MTXP01BESPL.51.86.H09.1.454.CMB.2.raw
  modified_base (384)..(384): a, c, t, g, unknown or other
  modified_base (397)..(397): a, c, t, g, unknown or other
  modified_base (407)..(407): a, c, t, g, unknown or other
  modified_base (535)..(535): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatggaaacacctacttgaattggttacagcagaggccaggccaaatctaccaagacgccttaaatttataaggtttctaaacgggtactcgtggggtcccagacagattcagcgcaagtgggtcaggcactgatttcanactgataatcganagggtggagntgaggtattgttggtttattacgtggctatgacaaggtacagacgtggccctggggaccgttcggaccgaaacggggaccgaaagggtaggaaatacgaaacgaacgttggttaggcctgcctaaccnttcgtgttctcg

SEQ ID NO: 377513 - DNA, 579 bp, Homo sapiens
  misc_feature: GZ8MTXP01C1ETX.51.86.H09.1.454.CMB.2.raw
  modified_base (301)..(301): a, c, t, g, unknown or other
  modified_base (313)..(313): a, c, t, g, unknown or other
  modified_base (339)..(339): a, c, t, g, unknown or other
  modified_base (392)..(392): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagccgcctccatctcctgcaggtctagtcaaggcctctatatagtgataggaaacacctattgaattggtcagcagagccagcaatcacaagacactaatttanaagttcaacggntcgcggtccagacagatccaggcganaggtgggtcaggcaactgtactttcacgactgaataagtcgagagggtggagngtagaaggtgttaggtttacgggtttattacgtgtatagtacgtacgtaaaggtactaacgacgttcggccggttacgggggtacgttccggggaaccgtaaacggggaaccgaaggggtaacgaaagtacaaaacggaactgggttaggcttacgaacacctaattcgtcttctttcaacgttccc

SEQ ID NO: 377514 - DNA, 614 bp, Homo sapiens
  misc_feature: GZ8MTXP01ELY8K.51.86.H09.1.454.CMB.2.raw
  modified_base (291)..(291): a, c, t, g, unknown or other
  modified_base (393)..(393): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgataggaaacacctattgaattggtcagcagagcagccaatcacaagacncttaattataagttcaacggactcgtgggtccagacagattccgaggcggacgaggtggtacaggctatgtatttcgaactacgtgaataacgtcgaacggnggggtaggaggtgttaggagggttattgggttttacggtttaatacgtagtcgtaggtacggtaacgtaaacggtacaactacggtcggccggttacgggggtaccgttacgggaaccgaaacggggaaccgaaagggttacgggaaaatacggttaaaaacgtacgtggttacggcttacggaactacctaatcggtcgttacctttcaaccgtttcccg

SEQ ID NO: 377515 - DNA, 606 bp, Homo sapiens
  misc_feature: GZ8MTXP01BLWHA.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctattgaatttggttacagcagacggccaggccaaatctaccaaagaccgtaccttaaatttaagtaacggtttacctaaaccgggacttcgtcgggggtacccagacagacttcgagcggcaagggtggcaggcactgtatttcactactagataagtcgagaggggtggaggctggaaggtattggtttaggtttattacgtggctagtcgacgtaaagggtaccacgacgtcgggccgtagggggtaccgttaccgggacggaaacggggtaaccgaaagggtagggaaatacgaacggaacgttaacgttggtaaggctaaggcctaaccgattcgttaagtttcc

SEQ ID NO: 377516 - DNA, 579 bp, Homo sapiens
  misc_feature: GZ8MTXP01CQDVP.51.86.H09.1.454.CMB.2.raw
  modified_base (331)..(331): a, c, t, g, unknown or other
  modified_base (355)..(355): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagcccggcctccatcctcctgcaggtctagtcaaggcctctatatagtgatggaaacacctacttgaattggttcagcagaggccaggcaatctaccaagactaccttaatttataaggtttcaaaccggntcgtgggtacccagacagattcgngcggcaaggtgggtcagggcacgtgatttcactactagaataagtcggagagggtgggagtcgtggaggtattggtttagggtttattacgtgggactagtcgacgaaggtcacgtacgtcggccgtggggtacgtcgggccgaaagggaaccaagggtacgaaagtaacgaaacgttaacgttggttacggctagcctaactattccttaaggttctttaacc

SEQ ID NO: 377517 - DNA, 596 bp, Homo sapiens
  misc_feature: GZ8MTXP01B49NK.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacagccggcctccatctcctgcaggtctagtcaaggcctcctatatagtgatggaaacactacttgaattggttcagcagaggccaggccaatctccaagacgccttaatttataaggtttctaaccgggctcgtggggtcccagacagattcagcggcaaggtgggtcagggccacgtgtactttcacactgataatcgacgaggggtggaggctggagggtagttggtttgggttttattacgtggggtctagtgacgtaaaggtaccacgacgttcgggcccgtggggtaccgttccgggaccgaaaggggtacccgaaagggttacggaaagtaccgaaacggttaaccgttgggttacggtctggaaccaccgtattccgtggttctttaacc

SEQ ID NO: 377518 - DNA, 574 bp, Homo sapiens
  misc_feature: GZ8MTXP01DHAR2.51.86.H09.1.454.CMB.2.raw
  modified_base (362)..(362): a, c, t, g, unknown or other
  modified_base (409)..(409): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatggaaacactacttgaattggttcagcagaggccaggcccaaatctccaaagacgccttaaatttataaaggtttctaaaccggggactcgtggggtcccagacagattcagcggnaagtggcagcactgattcacactagataatacgacgaggtaggaggngtagagtagttagttaggtttagttagtggtctagtagacgaacgtaacgacgacgtacggtcggtcgggtacggtacggtacggaacggaaacggaaacggtaaaggaaacgtaaacgtaaacgaaacgttagttacgtcgtcgaacacacttactcgttcgtc

SEQ ID NO: 377519 - DNA, 586 bp, Homo sapiens
  misc_feature: GZ8MTXP01C1S26.51.86.H09.1.454.CMB.2.raw
  modified_base (368)..(368): a, c, t, g, unknown or other
  modified_base (394)..(394): a, c, t, g, unknown or other
  modified_base (410)..(410): a, c, t, g, unknown or other
tcagcgatcgtatacacgaccggtgctcgatttagtgctatagacttgggtttgggggatcaggactcctcagttcaccttctcacaatgaggctccctgctcagctcctggtgctgctaatgctctgggtcccaggttccagtggggatgttgtgctgactcagtctccactctccctgcccgtcacccttggacagccgcctccatctcctgcaggtctagtcaagcctctatatagtgataggaaacactacttgaatggttcagcagaggccaggccaatctaccaagacgaccttaaatttataacggtttctaacccgggactcgtggggtcccagacagtacttcagcggcaggtgggtcnggcacgtgtattcactactagataancggagaggggtgaggntggaggtagttggtttggtttattacgtgctaagttgaacgtaaggtacaaccgtacgtcggcccgtaggggtaccgttcggaccgaaaggggaaccgaagggttagggaaaacttacgaaaaacggtacgttaggttggctaaggacctaacctattcgttcgttccttcgtaac

SEQ ID NO: 377520 - DNA, 592 bp, Homo sapiens
  misc_feature: GZ8MTXP01DK7WH.51.86.H09.1.454.CMB.2.raw
  modified_base (580)..(580): a, c, t, g, unknown or other
tcagcgatcgtatacacgaccggtgctcgatttagtgctatagacttgggtttggggactgatcaggactcctcagttcaccttctcacaatgaggctccctgctcagctccgtggggctgctaatgctctgggtcccaggttccaggtggggatgttgtgctgactcagtctccactctccctgcccgtcacccttggacagccgcctcatctctgcaggtctagtcaaggcctactatatagtgataggaaacactatgaattgttcagcagagccagcaatctacaagacgacttaaatttataacggtttcgtaacggctacgtcggggtaccagaccagacttacgaggccggacaagggtcgggtcagggccaacttgtactttcaactactagtaataagtcggaggtaggggttagggaaggtgttagggaagggttagttggttttagggttttaattacgtggtactagtacgacgtaaaggtaccacgtacgtcggtccgtgggtacgtcggacgaaagggacgaaaggtaggaaacaacgtaacgaacgttggacggctagccaactnttcttcgttctc

SEQ ID NO: 377521 - DNA, 659 bp, Homo sapiens
  misc_feature: GZ8MTXP01CWCTW.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctccatctcctgcaggtctagtcaaggcctctatatagtgatagaaacacctacttgaattggtcagcagagcaggccaatctacaagacgtaccttaatttagttaacggtttctaaaccgggtacttcgtcgggggtaccccagaacagtacttccgaggtcggcaggtggtacaggcactgtatttcacactagaataatcgaacgaggggtgaggcgtaggtagggtaattgggtttagggtttattacgtaggtactaggttacgacgtaaacggtacacgtacgtcggtaccgttacggggaccggtttcgggaccgtaaacggggaacccgtaaagggttaagggaaaacttaccgaaaaacggtaaaccgttggttaacggggttcttacgggaacctaaaccccggttcgttccgttacgttaccttaaccgttaaccgttccccg

SEQ ID NO: 377522 - DNA, 721 bp, Homo sapiens
  misc_feature: GZ8MTXP01B9YZK.51.86.H09.1.454.CMB.2.raw
  modified_base (253)..(253): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatggaaacnctattgaattggttcagcagaggccaggccaaatctaccaagacgtaccttaaatttagtaaacggtttcctaaaccgggggacttcgttacgggggtaccccaaaggacctaaggtatttacgaaggcccggacgtaaagggttgggggtccaaggggtcccaaaccgttggtaaacttttccaaactaaccttagaaattaaacgtccggaacggtaagggggttagggaaaccgggtcgttagggaagggttagtttagggttttaggggtttttaaccttacgttggggactagttacggaaccgttaaagggtaccacgtacgttcgggccgttacgggggaaccgtttccggggaaccgaaacgggggaaccgttaaaggggtaaagggaaaactaacggaaaacggttaaacggttggacgggctacgggaacaacccttagttcgttcgttcgttaaccg

SEQ ID NO: 377523 - DNA, 640 bp, Homo sapiens
  misc_feature: GZ8MTXP01CRHE0.51.86.H09.1.454.CMB.2.raw
  modified_base (181)..(181): a, c, t, g, unknown or other
  modified_base (485)..(485): a, c, t, g, unknown or other
  modified_base (490)..(490): a, c, t, g, unknown or other
  modified_base (527)..(527): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctccgtggggctgctaatgctcgtgggtcccaggttccaggtggggatgttgtgctgactnagtctccactctccctcgcccgtcaccgttggacacgccgcctcatctcctgcaggtctagtcaacggtcctactaatatagtgaatagaaactctattgtaattggttacagacgaggacggaccaaggaccaatacctaccgaaagtaccgttacctttaaatttagttaaacggtttccgaaaccgggtctcggttaccggggacccaaggactaaggacttacgaggtcggagtaagggttgggacaagggtctacgttagtactttacaacgtagtagtaataagtacggagtagggtnagtgngtaggtagttaggtttggtttaggtttatacgtgtanagtacgaacgtacgtacacgtcgtcgggtcgtagggttacggtacggaacggaaacggtaacgaaggttacgaaacgtaacgaaacgtaacgtggacgctaacgaacgtaacg

SEQ ID NO: 377524 - DNA, 580 bp, Homo sapiens
  misc_feature: GZ8MTXP01DB6C3.51.86.H09.1.454.CMB.2.raw
  modified_base (377)..(377): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacacgcccggcctccatcctcctgcaggtctagtcaaggcctctatatagtgatggaaacactacttgaattggttcagcagaggccaggccaatctaccaagacgtacctttaaatttataaggtttaccaaaccggggctcgtcggggtcccagacagatcagcgnaggtgggtcaggctactgactttcactactgaataaagtcgacgaggggtggaggctaggaggtagttgggggtttagggttttattacgtgcgtagtgacgtaaagtctactacgtggccgttaagggcgttcggaccgaaagggaccgaaggttacggaaattacgaaacgaacgtggtacgcgttacgaacaaccgtaag

SEQ ID NO: 377525 - DNA, 599 bp, Homo sapiens
  misc_feature: GZ8MTXP01CP8MK.51.86.H09.1.454.CMB.2.raw
  modified_base (251)..(251): a, c, t, g, unknown or other
  modified_base (262)..(262): a, c, t, g, unknown or other
  modified_base (268)..(268): a, c, t, g, unknown or other
  modified_base (286)..(286): a, c, t, g, unknown or other
  modified_base (310)..(310): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatgaaacnctatgattgtnagcagngcaggccaatctcagacnctaattataagttcaacggctcgngggtccagacagattccaggcggcaggtgggtacaggcactgtatttcacactgataagtcgacgagggtggaggcgtaggaggtagttggtttagggttttattacgtgcgtaagtggtacgtaaaggttacaacgtacgtgggtaccgttgggggtacgttccggggaccgtaaacggggaaccgaaagggtaacggaaacgttaaccggaaaggtaaaccgttgggttacgggttcttacggaacctaacccgtaattccgttcggttccttccgaactttccccg

SEQ ID NO: 377526 - DNA, 638 bp, Homo sapiens
  misc_feature: GZ8MTXP01BMSC7.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccaggtggggatgttgtgctgactcagtctccactctccctgcccgtcacccttggacagccggcctccatctcctgcaggtctagtcaaggcctctatatagtgatggaaacacctacttgaattggtcagcagaggccaggccaatctaccaaagacgaccttaaatttagtaacggtttcctaaccggggacttcgtcgggggtccccagtacagtacttccgaggcggacgaggtgggtaacagggcatgatttcacactgataacgtcgacgtaggggtggagcgtaggaggtagttggtttgggtttaactacgtggtactagggtcgtacgtaaacgggtaccacgtaccgtcgggtacccgtagggggtaccgttccgggacgtaaacggggaccgtaaagggtacggaaacttacgaaacgggtaactgggttacgggttcttacggaaccctaactcttcggtcgtttaccgtcgttaactttcccccg

SEQ ID NO: 377527 - DNA, 632 bp, Homo sapiens
  misc_feature: GZ8MTXP01ATBTW.51.86.H09.1.454.CMB.2.raw
  modified_base (436)..(436): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaaatctccaagacgcctaatttataaggtttcaaccgggactcgtggggtcccagacagatcagcggcaaggtgggtcaggcactgatttcactactgataatcgacgagggtggaggctggaggtattgtttacgggtttattacgnggggcaagttgaccgaaagggttaccaacgtacgtcgggtcccgtgggggtaacgttccgggacccggaaagggggaacccttaaagggggttaccgggaaaattacccggaaaaacggttaaccgttgggttacggggcccttagggaacccgaaccccgtaaatttacccgtcggtttaacccgtttaaccccg

SEQ ID NO: 377528 - DNA, 570 bp, Homo sapiens
  misc_feature: GZ8MTXP01DDUIC.51.86.H09.1.454.CMB.2.raw
  modified_base (538)..(538): a, c, t, g, unknown or other
  modified_base (547)..(547): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctccatctcctgcaggtctagtcaaggcctctatatagtgataggaaactcctattgtaattggtcagcagacgccaggccaatctacaagacgcttaattataaggttcaacggactcgcgggtaccagttacagacttccgaggcggcaggtcgggtaccagggcactgtactttacactactgaataagtcgacgtagcgtaggaaggctaggtaggtagttgggttaggtttattacgtggactaagtggaactaaggtacactacgtcggcgtgggtacgttcgggaccgaagggtaaccgagggttagaaattacgaaacgacttggnggactgacncctatccttagttcttcgtaacc

SEQ ID NO: 377529 - DNA, 613 bp, Homo sapiens
  misc_feature: GZ8MTXP01C7218.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacacgccgcctcatctcctgcagtctagtcaaggcctctatatagtgatagaaactactattgaattggttcagcagagccagccaatctaccaagacgaccttaaatttagtaacggttttccaaaccgggtctcgtacgggtacccagacagatcgagcggcaaggtcgggtcaggctacgtgtacttacactactagaataagcgaagaggggtagacggtgtaggaaggtagttggtttagggtttatacgttggacgtagtagacgaaaggtcaacgtcggtacggccgtaggggaccggttaccgggaaccgggaaacgggtaaccggaaagggttacggaaaacgtaaccgaaaacggttacgttggacggtctacggaacgtaacccttgttacgttcgttcgtccg

SEQ ID NO: 377530 - DNA, 539 bp, Homo sapiens
  misc_feature: GZ8MTXP01CDO01.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacactacttgaattggtttcagcagaggccaggccaatctccaagacgcctaatttataaggtttctaccgggactcgtcggggtcccagacagattacagcggcagtgggtcaggcactgatttcacactgataatacgacagggtgaggctgaggagttgggttgggttttattactgcatgcaaggtcacacgtggccgtggggacgttcgggccgaagggtaccgaagggttaggaattacgaacgaacgtgtggcttgtccgcgtaacg

SEQ ID NO: 377531 - DNA, 556 bp, Homo sapiens
  misc_feature: GZ8MTXP01AJF91.51.86.H09.1.454.CMB.2.raw
  modified_base (535)..(535): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctaccaagacgtccttaaatttataaggtttcaaccgggactcgtggggtcccagacagtatcgagcggcaaggtgggtcagggcacgtgtatttcactactgataagtcgacgaggggtggaggcgtggaggtagttggtttagggttttattacgtggactagttgacgtaaggtacacgtacgtggccgtggggaccgttcggaccgaagggacaagggtagaaagtacgaaagacgttgnggctgcacgattctgttcttc

SEQ ID NO: 377532 - DNA, 594 bp, Homo sapiens
  misc_feature: GZ8MTXP01DUR7K.51.86.H09.1.454.CMB.2.raw
  modified_base (254)..(254): a, c, t, g, unknown or other
  modified_base (417)..(417): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgatggaaacnctattgaattggttcagcagaggccaggccaaatctacaagacgaccttaaatttagtaaggtttctaacgggactcgtcgggtccagacagattcgagcgcaaggtggtcgaggtcaactgactttacactactgtaataatcggaagaggggtggaaggtnttaggaaggtagttaggtttagggtttaacttcgttggactagtgaacgtaaggtacaacgtcgttacggccggtgggtaccggttccgggaccgtaaagggtaccgaaagggtaaggaaataaccggaaacgttaacgttggttacgggctcaacgtaacctgttcttgttcttcg

SEQ ID NO: 377533 - DNA, 651 bp, Homo sapiens
  misc_feature: GZ8MTXP01AN579.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagagccaggcaatctccaagacgtcctaatttataaggtttctaaccgggactcgtggggtcccagacagattcgagcggcaagtgggtcagggcaactgatttcacactgaataagtcgagagggtggaggctaggagtagttggtttagggtttattacgtgggactagttcgaccgtaaagggttaccacgtaacgtcggggtcccgtagggggtaacccgtttcggggaccccgtaaaagggggaaccccgttaaagggggttacggaaaaaacgttccggaaaaaaccggttaaaccgtttcgggttagggggaacccttagggcccgtaaaccccgtagttccttaacggttttaacccgtttaacccg

SEQ ID NO: 377534 - DNA, 568 bp, Homo sapiens
  misc_feature: GZ8MTXP01EJZBL.51.86.H09.1.454.CMB.2.raw
  modified_base (255)..(255): a, c, t, g, unknown or other
  modified_base (274)..(274): a, c, t, g, unknown or other
  modified_base (287)..(287): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacnctatgaattgttcagcagngccaggccaatcncaagcacttaattataaggtttcaacggactcgtgggtccagacagattcgagcggcaaggtgggtcaggcactgtactttcgactactagataagtcgagagggtggaggctaggaggtagttgtttagggttttattacgtgggactagtacgacgtaaggtacacgtacgtcggtcgtggggtaccgttcggacccggaaaggggaaccttaaagggtacggaaaatcgaaaacgttacgttggttacggctgaacctaccattctcgttcttaaccg

SEQ ID NO: 377535 - DNA, 631 bp, Homo sapiens
  misc_feature: GZ8MTXP01C6CKY.51.86.H09.1.454.CMB.2.raw
tcagcgatcgtatacacgaccggtgctcgatttagtgctatagacttgggtttggggacccttgccttgactgatcaggactcctcggttcaccttctcacaatgaggctccctgctcagctcctggggctgctaatgctctgggtcccaggttccagtggggatgttgtgctgactcagtctccactctccctgcccgtcacccttggacagccggcctcatctcctgcagtctagtcaaggcctctatatagtgatgaaacactattgaattggttcagcagagccaggccaatctaccaaagaccgacctttaaatttaagtaacggttttcaaaccggggacttcgtcggggtaccccccagacagattcgaagcggcaggtgggtcaagggcacgtgactttcaacactagaataaagtcggaacgagggggtggaaggcgttaggaagggtattcgggtttagggggttttattaacgtgactattcgacgtaaagggttacaacgtacgtcgggcccgtgggggtaaccttcgggttaccggaaacgggaaccgtaaagggtaaggttaaaagttacgaaaaaccgtaagtaggttcggcggtacaccgtaaccaacgtttccg

SEQ ID NO: 377536 - DNA, 648 bp, Homo sapiens
  misc_feature: GZ8MTXP01BE2A5.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagacggccaggccaatctaccaagaccgtaccttaaattttagtaaacggtttacctaaaccggggtacttcgtacgggggtacccaggacaacgtattcgaggcggcaaggtgggtcagggcacgtgtatttcactactagaataagtcggacgaggggtggagggtctaggagggtattgggtttagggttttaattacgtggggtactaagttggaacgtaaagggtaccaacgtacgtagggcccgttaggggtaccgttccgggaaccggtaaaggggaacccgaaaggggttacgaaaacgtacgaaaaacggacgttggttacgggaacctacggccaacccgtattccgttcgttcgtttaaccg

SEQ ID NO: 377537 - DNA, 733 bp, Homo sapiens
  misc_feature: GZ8MTXP01EE0MX.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcagtctagtacgaacgcctactatatagtagagtacgaaactaccttacttagtaagtttggttacagcgaaggacggaccgaacggaccaaatcctaaccgaaacgtaccgtacctttaaaattttaaacgtttaaacggttttaccgtaaaccggggtaccttaccggttacgggggtacccaaacggaaccgtaagtacgtttaccgaacggggcggtacggtaacggggttcggggtaaccgaacgggtccgtaacgttaggttacttttacccgaactaacgtagtaaactaacgtacgaacggtagggggtcggagggtacgtagggtaggttaagtttcgggtttagggtttacttaacgtgtactaggtcggaacgtaaacggtacacgtacgtcgggtacgtagggtaccgttcgggaaccgaaagggaaccgaaagggtaacggaaactacgaaaccgtaagtcggagcgttcgaactactaacttcgtcttacttcttaactccccg

SEQ ID NO: 377538 - DNA, 542 bp, Homo sapiens
  misc_feature: GZ8MTXP01CHOVF.51.86.H09.1.454.CMB.2.raw
  modified_base (254)..(254): a, c, t, g, unknown or other
  modified_base (287)..(287): a, c, t, g, unknown or other
  modified_base (294)..(294): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacnctattgaattggttcagcagagccagccaatcncaagacncttaatttataaggtttcaaccggctcgtgggtacccagacagattcagcggcaaggtgggtcagggcactgactttcactactgataagtcgacgaggggtggaggctaggaggtagttggtttagggtttattacgtggctaatgacaaggtacacgtacgtcggccgtgggacgttcgggcgaaaggggaccaaagggtaggaaactacgaaacgacgttggcggctgcaccattctcgttcttc

SEQ ID NO: 377539 - DNA, 532 bp, Homo sapiens
  misc_feature: GZ8MTXP01A7RNU.51.86.H09.1.454.CMB.2.raw
  modified_base (267)..(267): a, c, t, g, unknown or other
  modified_base (305)..(305): a, c, t, g, unknown or other
  modified_base (314)..(314): a, c, t, g, unknown or other
  modified_base (521)..(521): a, c, t, g, unknown or other
  modified_base (528)..(528): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctctatctcctgcaggtctagtcaaggcctctatatagtgatggaaacnctattgaattggttcagcagagccagcaatcacaagcnctaatttanaaggtttcaacggctcgtcgggtcccagacagatcagcggcaggtgggcaggcacgtgatttcactactgaataagtcggaacgtaggggtggaggcgtaggaggtagttggggtttggttttatacgtgctagtcgactaaggtcacgtacgtggccgtgggaccgttcggaccgaagggacgaaggttagaattcgaaagcgtgngcttgcncgtg

SEQ ID NO: 377540 - DNA, 614 bp, Homo sapiens
  misc_feature: GZ8MTXP01EZHVJ.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagcccggcctccatctcctgcaggtctagtcaagcctctatatagtgataggaaacacctacttgaattggttacagcagagccaggccaatctacaagacgtaccttaaatttagtaaggtttacctaaccgggtactcgtcgggggtaccccagacgagtacttcgagtcggcaagggttgggtcagggctacgtgtactttcactactgaatagtcgacgaggggtaggagcgtaggaggtattggttagggttttatacgtggactagtacggactaaagggtacacgtacgtcgggccgtaggggtaccgttcgggaccgaaacggggtaaccttaaaggggtaacgttaaacgtaacgaaaacgaacgttggttcgcgtgaaccacctagttccgttgttccgttaacc

SEQ ID NO: 377541 - DNA, 626 bp, Homo sapiens
  misc_feature: GZ8MTXP01DTCYW.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatggaaacactattgaattggttcagcagaggccaggccaaatctaccaagaccgtaccttaaatttagtaaacggtttcctaaaccgggcttcgtcggggtcccaggacagattcgagcggcaaggtgggtcagggcacgtgtattcactactagaataatcggacgtaggggtggaggctggagggtattaggtttagggtttattacgtgggtactagttagacgtaaaggtacacgacgtcggtccgtggggtacgttcgggaccgtaaaggggaaccgaaagggtacggaaaagtaaccgaaaacggttaaccgttggttacgggtaaccttacggaacccgtaaccctagttaccgttcggtttccgtttaacccg

SEQ ID NO: 377542 - DNA, 615 bp, Homo sapiens
  misc_feature: GZ8MTXP01BB0L5.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtctccactctccctgcccgtcacccttggacagccggcctccatctcctgcaggtctagtcaaggccctcctatatagtgatggaaacacctacttgaattggtttcagcagaggccaggccaatctaccaaagacgccctttaaatttagtaaggtttcctaaaccgggacttcgtcgggggtaccccagacagtattcagcggcaggtgggtcagggcactgatttcatactgaataagtcgacgtaggggtggaggctggaagggtattgggggttttaggggtttttattaaccgtggtacagttgacgaagggtacacgacgttcggccgtggggtaacgttccgggacgaaacggggtaacccgaaagggttagggaaacttacgaaaaccggtacgtggtcggggacttacggccttaacccgtaag

SEQ ID NO: 377543 - DNA, 811 bp, Homo sapiens
  misc_feature: GZ8MTXP01BSOXU.51.86.H09.1.454.CMB.2.raw
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggtcctctaatagtagtgatacggaaactcgttacttgaatttggttacagcaggacgaccaggccaatctaccaagtacgtacctttaaatttacgttaaggtttaccgtaaccgggtacttcgtacgggggtaccccaagtaccagtacttacgaggtcggacgtaaacgggttcgggaactacgggtaccctaacgtttggttaacttttcccgaaaccgttaacgttaacgggtaaatttaaacggttcccggaaacgggggtaagggggttacggggtaaacgggttacggttttacggggtaaggggtttaggtttttacggggtttttaacggggttttttaaattaaaccggttggttaccgtaaaggtttacgggaaaccgggtaaaacggtcccgtaaaccgttaaccggttacgggtccgggggttaacggggtaccggttaccgggggaaacccgtaaagggggtaacccgttaaaggggttaacggaaacctaaacggtaaacccgttaaggtttcggacgggtcgttacgaaccgtactacggtttccgtaacgtttccgtttaacccg

SEQ ID NO: 377544 - DNA, 645 bp, Homo sapiens
  misc_feature: GZ8MTXP01CE8EG.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacnctattgaattggttcagcagaggccaggccaatctaccaagacgaccttaaatttagtaacggtttctaaaccgggacttcgtcggggtacccagacagattcgagtcggactaagggttgggtcaagggtcctaacgttgtaacttttcgaactactagaacttaaagtcggaacggagggggtgggaagggtctagggaaggtagttggtttaggggttttaattacgtggctagtcgaacgtaaagtacacgtacgtcggccgtaggggtaccgttacgggaccgaaaggggaacccgttaaaggggtaacgaaacgttaaccgaaaaggttaaccgttggttacgggctaggaacctaacctagttccttaacgttcgtttaaccg

SEQ ID NO: 377545 - DNA, 590 bp, Homo sapiens
  misc_feature: GZ8MTXP01CUIJ9.51.86.H09.1.454.CMB.2.raw
  modified_base (296)..(296): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctcctatatagtgatagaaacaccttacttgtaattggtcagcagaggccagccaatcacaagacnctaatttataaggttcaaccggctcgtcgggtaccagacagattccaggcgcaggtcgggtacaggctactgtactttcgaactactagaataatacgaacgtaggggtggaggacgtaggtagggtagtttggtttagggttttattacgtgtacgtagtacggactaaacggtacacgtacgtggtccgttagggacgttccggacgaagggaacgaaaggtaggaaagtacgaaacgtaaacgtggttacggcttacggcaccgtaatcgtgttcctttaacgctttcccg

SEQ ID NO: 377546 - DNA, 645 bp, Homo sapiens
  misc_feature: GZ8MTXP01DMAZ2.51.86.H09.1.454.CMB.2.raw
  modified_base (258)..(258): a, c, t, g, unknown or other
  modified_base (267)..(267): a, c, t, g, unknown or other
  modified_base (505)..(505): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagcccgcctcatctcctgcaggtctagtcaaggcctactatatagtnatagaaacnctattgaatttggttacagcagaggccaggccaaatctaccaagaccgtacctttaaaattttacgtaaaggtttccaacggtcgtcgtaccggggtccaagacgagtacgtacgacgcggactagggtcgggtacgacgcgactacgtactttcaacacttagaataagtaccggagaaggggtggaggcgtagtaagggtagttacgggggttttagggttttaacgttactgacngtcgtaacaaacgggtacaccgtagtcggtcccggtaaggggtaccgttcgggaaccggaaacggtaaaccggtaagggttaacgggaaattaaacccgaaacggaactcgggtaagggtccttcggaaccaactaacgg

SEQ ID NO: 377547 - DNA, 849 bp, Homo sapiens
  misc_feature: GZ8MTXP01BVSLD.51.86.H09.1.454.CMB.2.raw
tcagcgatcgtatacacgaccggtgctcgatttagtgctatagacttgggtttggggactgatcaggactcctcagttcaccttctcacaatgaggcctccctgctcagctccgtggggctgctaatgctcgtgggtcccaggttccaggtggggatgttgtgctgactcagtcctccactcctccctgcccgtcacccgttggaccacgcccgcctccatcctcctacgacgtctacgtacgacgacctcctatatagtagtagtagaacgtaacctacttagtagtaggttcgtagacgacgacggaccgacggacctaactactaccgaaacgacgtaccttaaagtttaagttaacggtttacgtaacccgggtaccgtcgtacgggtacccgacaacgacgtacgttccgtagccggggtacacggtaaggggttaccgaacggacgtaacctacggttactttaactaccgaaaccttgggtaaataaacccgttaccgggacgggtaagggggttagggttagggaccttaggggtaggttaaagggttttccccggttttttagggggttttaatttaaacccttcggggactaaaacggttttagggaacccgaaaaacgggggttttaaaacccccgaccggtacccgggtttaacggggttccccggggttaccgggggtaaacccgggttaaccggtaaacccgggaaaaccgggggtaaacgtaaaccggggttaaaggtaaaaacgttaaacccgtaaaacccgggtaagttcggggttcgaccgtaaccacctaacccgttagttacgtttcggttaacccctttaacaacccg

SEQ ID NO: 377548 - DNA, 579 bp, Homo sapiens
  misc_feature: GZ8MTXP01C8F7N.51.86.H09.1.454.CMB.2.raw
  modified_base (427)..(427): a, c, t, g, unknown or other
  modified_base (551)..(551): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacagcccggcctccatctcctgcaggtctagtcaaggcctctatatagtgatggaaacacctacttagaattggttcagcagaggccaggccaaatctaccaagacgacttaatttataaggtttcctaaccgggactcgtgggtcccagacagattcagcggacaaggtgggtcaggctacgtagatttacacactgaataatcggaagaggggtggagcgtgaggtnttgttgggtttatacgtggactagtgacgtaaggtacacgtacgtgggccgttggggaccgttcgggaaccgaaaggggaaccgaaaggggtaagaaaacgtacgaaaacgacgttggacggtntacgcaaccgtattcttcgttaacttcg

SEQ ID NO: 377549 - DNA, 636 bp, Homo sapiens
  misc_feature: GZ8MTXP01CEYYI.51.86.H09.1.454.CMB.2.raw
  modified_base (254)..(254): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatgaaacnctatgaattgtctagcagagccagccaatcctacaagacgtacttaaatttagtaacggtttctaaaccggggcttcgtcgggggtacccaggactaggattcgagtcggcaagggtgggtcagggcctacgtgactttcactactagaataagtcggaacgtaggggtggaaggtcgtaggagggtagttcggtttagggttttatacgttgggatagttacgaacgtaacgggtaccacgtacgtacgggtccgtacgggggtaccggttccgggaccggaaacggggaaccgttaaaggggtaaacggaaacttaaacgaaaccggttaaacgttggacggtcgtagaaccgtaactacgttctcggttccgtttaacc

SEQ ID NO: 377550 - DNA, 631 bp, Homo sapiens
  misc_feature: GZ8MTXP01EIQV9.51.86.H09.1.454.CMB.2.raw
  modified_base (445)..(445): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcaccttggacagccgcctcatctctgcaggtctagtcaaggcctctatatagtgatggaaacactattgaattggttcagcagagccaggccaaatcctaccaaagtaccgtaccttaaatttagtaacggtttcctaaaccgggtactcgttcgggggtaccccaaggacctaagtacttcgaaggcggcgaaagggtgggtccgagggtacactgtactttcactactgaataatcggagaggggtggaacggtnttaggaggtattgggtttagggtttattactaggggtctagtgtacaaaggtacacgtacgtgggtcccgtggggaaccgtttcgggacccgaaaaggggaccgaaaggggtaggaaaactacgaaaacgttaacgttggttacggaacctaggaacctaaccgtattcgtaacgttctttaaccg

SEQ ID NO: 377551 - DNA, 551 bp, Homo sapiens
  misc_feature: GZ8MTXP01DZRQY.51.86.H09.1.454.CMB.2.raw
  modified_base (407)..(407): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactacttgaattggttcagcagaggccaggccaaatctacaagacgaccttaaatttataaggtttctaaaccgggactcgtggggtcccagacagatcagcgcgaagtgggtcaggcactgattcacactgaataatcgacagggtggaggngtagaggattggttagggtttaacttacgtgggcagtgacgtaaaggtacaacgagttcggccgtggggtacgttcgggacgaagggaaccgaaagggtagaaagtacaaacgagttgttagcgtagctacagttctgttcttc

SEQ ID NO: 377552 - DNA, 634 bp, Homo sapiens
  misc_feature: GZ8MTXP01DCWCA.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgataggaaacacctacttgaaattggttcagcagaggccaggccaatctaccaaagacgtacctaaattttataaggtttctaaccgggactcgtggggtcccagacagattccaggcggcaggtgggtaccagggcactgatttcacactgataatcgacgagggtggagctaggaggtattggtttagggtttattacgtgactagtacggacgtaaagggtacacgtaccgtgggtccccgttagggggtacccggtttccgggacccgtaaaagggggtacccaaaaggggttcgggaaaacttaccgaaaaacggtaaaccgttgggttacgggcttacggaacctaaccctaaggttctcggttacctttccgaactttcccccg

SEQ ID NO: 377553 - DNA, 598 bp, Homo sapiens
  misc_feature: GZ8MTXP01AIQ9G.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctattgaattggttcagcagagccaggccaatctccaagacgtactaatttataaggtttctaaccgggactcgtcgggggtacccagacagattcgagcggcaaggtgggtcagggcactgtactttcactactagaataagtcgacgtaggggtggaggcgtaggaggtagttggtttagggttttattacgtggggtctaagttggactaaaggtacacgtacgtcgggtccgtggggtaccgttccgggaccgaaaggggaaccgaaagggtacgaaacgtaacgaaaacggttacgttggttcggtcgcgaaccacgtagttcttcgttctttaacc

SEQ ID NO: 377554 - DNA, 565 bp, Homo sapiens
  misc_feature: GZ8MTXP01DCVAR.51.86.H09.1.454.CMB.2.raw
  modified_base (254)..(254): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctctgcaggtctagtcaaggccctctatatagtgatggaaacnctattgaattggttcagcagaggccaggccaaatctaccaagacgccttaaatttataaggtttctaacgggactcgtggggtacccagacagattcagcggcaagtgggtcagggcactgatttcacactgataatcgacagggtgaggctggaggtattgttcgggtttattacgtggtacagtagacgaaaggtacacgagtcggccgtggggtacgttcgggaccgaaaggggtaccgaaaggggttacgaaaagttacgaaaacggttaacgttggttacggctagcacctattctgttcgttaac

SEQ ID NO: 377555 - DNA, 537 bp, Homo sapiens
  misc_feature: GZ8MTXP01BFJMG.51.86.H09.1.454.CMB.2.raw
  modified_base (237)..(237): a, c, t, g, unknown or other
  modified_base (439)..(439): a, c, t, g, unknown or other
  modified_base (517)..(518): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgctcatctctgcaggtctagtcaaggcctctatntagtgatggaaacactattgaattggttcagcagaggccaggccaaatcctaccaagacgtcctaaatttactaaggtttctaaaccgggactcgtgggggtcccagacagattcagcggcaaggtgggtcagggcactgtatttcactaactgataaagcgacgaggggtgagcgtgaggagttgttggtttattactggnatgcgaacgtacgacacgtcggtcgtggtacggtcggacgaacggaacgaacggtaggaagtacaacgaacgagttgnngcacacttctcgttcgttc

SEQ ID NO: 377556 - DNA, 578 bp, Homo sapiens
  misc_feature: GZ8MTXP01DIDFP.51.86.H09.1.454.CMB.2.raw
  modified_base (254)..(254): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgatggaaacncctattgaattggttcagcagaggccaggccaaatctaccaagacgaccttaaatttataaggtttctaaccgggctcgtggggtcccagacagattcagcgcaagtggtcaggcaactgatttcacactagaataatcgacgagggtggaggctggaggtagttggtttagggtttattacgtgggtctagtgtacgaaaggtacacgacgtcgggccgtggggtaccgtttcgggaccggaaacgggaaccgaaagggtacggaaaagtacgaaaacgaacgttggttcggaactggaaccaccgattcctcgttaacttcc

SEQ ID NO: 377557 - DNA, 617 bp, Homo sapiens
  misc_feature: GZ8MTXP01EH4BJ.51.86.H09.1.454.CMB.2.raw
  modified_base (255)..(255): a, c, t, g, unknown or other
  modified_base (275)..(275): a, c, t, g, unknown or other
  modified_base (390)..(390): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacnctattgaattggtcagcagngccagccaatcacaagctactaaatttagtaagtttctaacggactcgtcgggtcccaggacagattcgagcggcaaggtgggtcaggcactgtattcactatagataatcgagnggggtgaggtctaggaggtattgggtttagggttttaattacgtgggactagttagacgtaaagggtaccacgtacggtcgggtccgttagggggaccgttaccgggaccggtaaaacggggtaaccgaaagggggttaaacgaaaacgtaaccgaaaacggttaaacgttgggttacgggaacctagggaaccctaacctagttccgttcggtttccgtttaaccg

SEQ ID NO: 377558 - DNA, 574 bp, Homo sapiens
  misc_feature: GZ8MTXP01CCEMF.51.86.H09.1.454.CMB.2.raw
  modified_base (201)..(201): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacngccggcctccatctcctgcaggtctagtcaaggcctctatatagtgataggaaacacctattgaattggttcagcaggacggccaggccaaatctaccaaagcgaccttaaattttataacggttttaccaaaccgggtactcgtcgggggtacccagacagattcgagcggacaaggtgggtcagggcacgtgatttcatactgaataagtcgaacgagggtggacggctggaggtattggtttgggtttaactacgtgggactagtgacaaggtacacacgtggccgtgggacgtcggacgaagggacaagggtacggaaatacgaaacgttacgttgttacggctacgcaccgtattcttgttcttaacc

SEQ ID NO: 377559 - DNA, 577 bp, Homo sapiens
  misc_feature: GZ8MTXP01EJXBS.51.86.H09.1.454.CMB.2.raw
  modified_base (409)..(409): a, c, t, g, unknown or other
  modified_base (421)..(421): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacagccggcctcatctcctgcaggtctagtcaaggcctctatatagtgataggaaactacctacttgaattggttcagcagagccagccaaatctacaagacgtacctaaatttataaggtttccaaaccgggtactcgtagggggtacccagacagattcgagtcgcaaaggttgggcagggcactgtatttcacacttgaataatcganagggtggaacgntggagtattggttagggttttatacgtggactagtcgacgtaaaggtcacgtagtcggtccgtggggtaccgtcggacgtaaagggaccaaagggtacggaaactaacgtaaacgaaagttggaggtctacgctaccgattcgtcgttcgttaacc

SEQ ID NO: 377560 - DNA, 467 bp, Homo sapiens
  misc_feature: GZ8MTXP01CTKYU.51.86.H09.1.454.CMB.2.raw
  modified_base (185)..(185): a, c, t, g, unknown or other
  modified_base (196)..(196): a, c, t, g, unknown or other
  modified_base (244)..(244): a, c, t, g, unknown or other
  modified_base (278)..(278): a, c, t, g, unknown or other
  modified_base (284)..(284): a, c, t, g, unknown or other
  modified_base (292)..(292): a, c, t, g, unknown or other
  modified_base (305)..(305): a, c, t, g, unknown or other
  modified_base (319)..(319): a, c, t, g, unknown or other
  modified_base (331)..(331): a, c, t, g, unknown or other
  modified_base (340)..(340): a, c, t, g, unknown or other
  modified_base (353)..(353): a, c, t, g, unknown or other
  modified_base (361)..(361): a, c, t, g, unknown or other
  modified_base (369)..(369): a, c, t, g, unknown or other
  modified_base (371)..(371): a, c, t, g, unknown or other
  modified_base (373)..(373): a, c, t, g, unknown or other
  modified_base (391)..(391): a, c, t, g, unknown or other
  modified_base (393)..(394): a, c, t, g, unknown or other
  modified_base (396)..(396): a, c, t, g, unknown or other
  modified_base (406)..(406): a, c, t, g, unknown or other
  modified_base (436)..(436): a, c, t, g, unknown or other
  modified_base (438)..(438): a, c, t, g, unknown or other
  modified_base (442)..(442): a, c, t, g, unknown or other
  modified_base (444)..(444): a, c, t, g, unknown or other
  modified_base (446)..(446): a, c, t, g, unknown or other
  modified_base (450)..(450): a, c, t, g, unknown or other
  modified_base (452)..(452): a, c, t, g, unknown or other
  modified_base (455)..(455): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgccctnacccttggacngccgctcatctctgcaggtctagcaagcctctatatgtgatcgaaacnctattggaattggtcagcagagccagccaattcnccagcnctaatttnaagtttcaacggntctagggccagacngtatccagcggntaggtgacngctatgtattcanatagatanagagaggngngngagagtgttgttgttatntnngngagagacacncgcgcgtcgtcgtcgacgacgagaagagananagangngncgcncnctntcttctcttctc

SEQ ID NO: 377561 - DNA, 577 bp, Homo sapiens
  misc_feature: GZ8MTXP01A3HHB.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgataggaaacacctacttgaattggtcagcagaggccaggccaaatctaccaaagaccgaccttaaatttataacggtttactaaccgggactcgtcggggtcccagacagattccaggcggcaggtgggtacaggcactgatttcacactgataatcgacgaggggtggaggcttaggaggtattggtttagggtttattacgtagctaagtgacgaaaggtacacgacgtggccgtaggggtaccgttcgggacgtaacgggaccgaaagggtggaaatacgaaacgtaacgtgttggcttgccactaatcgtgttccttcgaacgtttccc

SEQ ID NO: 377562 - DNA, 597 bp, Homo sapiens
  misc_feature: GZ8MTXP01CJBAT.51.86.H09.1.454.CMB.2.raw
  modified_base (246)..(246): a, c, t, g, unknown or other
  modified_base (255)..(255): a, c, t, g, unknown or other
  modified_base (374)..(374): a, c, t, g, unknown or other
  modified_base (428)..(428): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtnatggaaacncctattgaattggttcagcagaggccaggcccaatcctaccaaagaccgtaccttaaattttagtaacggttttcctaaaccggggctcggtcgggggtcccagacagattcgagcggnaagggttgggtcagggtcactgatttcacactgataatcgacgaggggtgaggngtaggaggtgttgggtttggtttatacgtggctaagtcgaacgtaagggtccacgtacgtcggggccgtgggggtaccttcggggaccgaaacggggtaccgaaaggggtacgaaacgtacgaaacgttaacgttggcggctcggccacctattcttcgttctttaacc

SEQ ID NO: 377563 - DNA, 566 bp, Homo sapiens
  misc_feature: GZ8MTXP01E28LT.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaaggccaatcctaccaagacgaccttaaatttataaggtttctaaccgggactcgtcggggtcccagacagattcagcggcagtgggtcaggcactgtattcacactgaataagtcgacgagggtggaggcgtgagtagttgggtttgggtttattacgtgcatgacaaggtacacgacgtggccgtggggacgttcgggaccgaaacgggaaccgaaggttagggaaaattacgaaacggaaactggttcgggcttcgccgaacctaacg

SEQ ID NO: 377564 - DNA, 601 bp, Homo sapiens
  misc_feature: GZ8MTXP01ECUEW.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagcccgcctccatctcctgcaggtctagtcaaggcctctatatagtgataggaaacactattgaattggttcagcagagccagcaatcacaagactacttaatttataggtttccaaccggctcgtcgggtacccagacagtattcgaggtcgcgtaagggtcgggtcgagggcctacgtagtactttcgaactacgtagattaaacgtcggaagaggggtggaggtcgtaggaggtagttcggtttagggttttaatcgtgggtactagttagacgtaaaggtcaacgcgtcgggcccgttaggggtaccgttcggaccggaaagggaccgaaaggggtacgaaacgtacgaaaacggttcgttaggcggaactgaacaccgtattcgtcgttcgttaac

SEQ ID NO: 377565 - DNA, 635 bp, Homo sapiens
  misc_feature: GZ8MTXP01D5FXB.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtcctccactcctccctcgcccgtcacccttggacagccgcctccactcctctgctagtctagtacgaacgtcctactaatagtagtagatacggaaactaccttattagtaagtttgtacagcaggacgccagaccaatccacaagactacttaattaagttaacggttacgtaaccggtctcggtcgggtaccagacagtactcgacggcggcgtaggtggacaggcacgtgtacttacactactagtaaatacgtacgaggtagggtgacgtgtagggtaggttagtttcggtttaggttatacgtgtagtacggtgtaaacgtaacgacctacgtacggtcggtacggtacgggtacgttacccggaaacgggaacggtaacggaaaggtaacgaaacgtaccgaaaggtaccgtggttcgcgttaccgctactaacgtttctacgttctttaaccgcctttccccg

SEQ ID NO: 377566 - DNA, 627 bp, Homo sapiens
  misc_feature: GZ8MTXP01C2QRK.51.86.H09.1.454.CMB.2.raw
  modified_base (338)..(338): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactacttgaattggttcagcagagccaggccaatctacaagacgacttaaattagtaaggtttcaaccgggntcgtcggggtcccagacagattacgagcgcagggtgggtcagggcacgtgtactttcactactagaataagtccggaagaggggtggaggctggaaggtagttggggtttacggggtttttatactggactagtcgacgtaaacgggtacaacgacgtcgggcccggttaaggggaccggtttccgggaaccgaaacgggggaacccgtaaaaggggttaacgggaaaattacccggaaaaacggtaaaccgttgggttacgggacttacgggaaccgaacccgttaag

SEQ ID NO: 377567 - DNA, 541 bp, Homo sapiens
  misc_feature: GZ8MTXP01ETLZR.51.86.H09.1.454.CMB.2.raw
  modified_base (390)..(390): a, c, t, g, unknown or other
  modified_base (403)..(403): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacacctacttgaattggttcagcagagccaggccaaatctccaaagacgtccttaaatttataaaggtttcctaaaccggggacttcgtggggtcccaggacagattcagcgcaagtgggtcaggcactgatttcanactgataatcganagggtgagctgagatgttggtttatactgggctatgacaaggtcactacgtggcctgggtacgttcgggcaaacggggaccaagggtaggaaactcaaaacgacgttagttgcctgcacctagttctcgttcttaacg

SEQ ID NO: 377568 - DNA, 627 bp, Homo sapiens
  misc_feature: GZ8MTXP01EK2VB.51.86.H09.1.454.CMB.2.raw
  modified_base (195)..(195): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacctggacngccgctcatctcctgcaggtctagtcaagcctctatatagtgatagaaactacctattgaattggtacagcagacgcagccaatcacaagactacttaatttataacggtttcaaccggtctcgtcgggtaccagacagtattccgaggcgcgaggtgggtacaggcatgtatttcatactagaatagtcgaagaggggtgagcgtaggaggttattgggtttaggtttatcgtagactaggtcgtaacgtaaaggtaccacgtacggtcggaccggttacgggggtaccgttaccgggaaccggtaaacggggtaacccgtaaaagggggtaacggttaaaacgtaaacggaaaacggtaacgttgggttacgggttcttacggtaaccaccgtaattccggttcgttaccttaacgttcctttaaccccg

SEQ ID NO: 377569 - DNA, 688 bp, Homo sapiens
  misc_feature: GZ8MTXP01AFVK2.51.86.H09.1.454.CMB.2.raw
  modified_base (372)..(372): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaagcctctatatagtgatggaaacactattgaattggtcagcagaggccaggccaatcctaccaaagaccgtaccttaaattttagttaaacggtttccgtaaccgggtacttcggtcgggggtcccaagacagattccaggcggnaggtgggtacagggcactgtatttcactactgaataagtcgacggaggggtggaggcgtaggaggtagttggtttagggttttattacgtgtcaggtgacgtaaggtacaacgtcgtcgggtaccgttgggggtaaccggttccggggaaacccgtaaacgggggtaaaccccggtaaaagggggtaaacgggttaaaaacgttaaccccggaaaaacgggttaaacccggttggggttacggggttccttacgggaacccgtaaaccgtctttccgttaccggtttcctttaacccgttaacccgttttcccccg

SEQ ID NO: 377570 - DNA, 602 bp, Homo sapiens
  misc_feature: GZ8MTXP01B0B5I.51.86.H09.1.454.CMB.2.raw
  modified_base (255)..(255): a, c, t, g, unknown or other
  modified_base (379)..(379): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctattgaattggttcagcagaggccaggccaaatctaccaagaccgtaccttaaattttataacggttttcctaaaccgggggtactcgtacgggggtccccaaggaccaggattcgagcggnaaggtgggtcagggcacgtgactttcgacactagataagtcgacgaggggtggaggcgtgaggtattggttgggttttattacgtggtcaagttgacgtaaaggtacacgtacgtggccgttggggaccgtttccggaccgaaacggggaaccgaaagggttacggaaataccgaaaacggaaccgttggttggctgaaccaccagttcttcgttcgtttaac

SEQ ID NO: 377571 - DNA, 658 bp, Homo sapiens
  misc_feature: GZ8MTXP01BOJJW.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatagaaacacctacttgaattggtcagcagaggccaggccaatctaccaagaccgaccttaaatttataaaggtttctaaccgggcttcgtcgggggtacccagacagattcccgagcggcgaggtcgggtcaggcactggtatttcactactgaattaaacgcgaacgtagggggtggaagggtcgtaggagggtagtttggtttaggggtttttattaacgtggactagtcggtacgtaaagggttaccaacgtacgtcgggtccggtaggggtaccggttcggacccgaaaggggaccgtaaaaggggtgggttaaaaacgtaccgaaaaaccggtacgttagggttacgggttccttaacggcaaaaccccgttcgttccgttcggtttaccttaaccgttaaccgttccccg

SEQ ID NO: 377572 - DNA, 712 bp, Homo sapiens
  misc_feature: GZ8MTXP01B7Q6F.51.86.H09.1.454.CMB.2.raw
  modified_base (470)..(470): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacactacttgaattggttcagcagacggccagccaatctaccaagacgaccttaaagtttataaaggtttcctaaaccgggtacttcggtacgggggtcccaaggacctaggtattacgaggtccggacgtaaagggttcgggtcaagggtcctaacgtgtaacttttccaactactagtaacttaaagtcggaaacgtaagggggtggaacgggtnttagggaagggtagtttggttttaggggttttaattaaccgttgggtacgtaagttcgaacgtaaaggttaccacgtaacggttcgggtcccgtagggggtacccggtttaccgggaccggaaacgggggtaacccgttaaagggggttaaggaaaacgttccgaaacggttaaacgggttaaacgttgggttaacgggcccttaaggtacccacccgttacgttcccgttaaggtttcccc

SEQ ID NO: 377573 - DNA, 635 bp, Homo sapiens
  misc_feature: GZ8MTXP01COCKQ.51.86.H09.1.454.CMB.2.raw
  modified_base (330)..(330): a, c, t, g, unknown or other
  modified_base (358)..(358): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctcgcccgtcacccttggacacgccggcctccatctcctgcaggtctagtcaaggcctacctatatagtgaataggaaactaccttattagtaattggtcagcagacggccaggccaatctacaagacacttaattataaggttccaacggtntcgtcgggtacagacagtatccgagcgnaggtggtaacaggcatagtacttcaactacgtagaataagtcgaacggtaggggtaggagggacgtagggagggttagttggttttagggtttatacgtgactaaggtcgtaacgtaaacggttacaaccgtacgtcgggtcgtacggggtaccgttaccgggaaccgtaaacgggaaaccgtaaaggggtaacgaaacgtaaccgaaacggtaaacctgggttacgcgttaccggaacaccctaagttccgtagttccttcttaaccgtttccccg

SEQ ID NO: 377574 - DNA, 651 bp, Homo sapiens
  misc_feature: GZ8MTXP01CVXYD.51.86.H09.1.454.CMB.2.raw
  modified_base (253)..(253): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatggaaacnctacttgaattggttcagcagaggccaggccaaatctaccaaagaccgtaccttaaatttagtaaggttttacctaaaccgggggacttcgtagggggtcccaggtacacgattcgagtcggctaaagggtgggtcagggtcactgactttcacgactgaatatcgagaggtggagcgtgaggtattgttggtttatactgggctagtagacgtaaaggtaccacgtaacgtcggtaccggttgggggtaccgtttacggggaaccccgtaaaagggggaacccgttaaaaggggttaacggaaaacgttaaacggaaacccggttaaaacgtttggggacggttccgttaggaacccgttaaccctagtttcccgttaacggttccgttttaacccg

SEQ ID NO: 377575 - DNA, 629 bp, Homo sapiens
  misc_feature: GZ8MTXP01DUPG0.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacacctattgaattggttcagcagacggccaggccaaatctaccaagaccgtaccttaaattttaagtaaacggttttcctaaaccggggacttcgtacgggggtacccaggacagacttcagcggcaaggtgggtcaggcactgattcactactgaataatcggacgaggggtaggaggtctgggaggtagttgggtttagggttttaattacgtggggtctaagttagacgtaaaggtacacgtacgtgggtcccgtggggtaccggttcggacgaaaggggaccgaaagggttacggaaaagttacgaaaacggaacgttggttacgggtaacgtacggaacctaacctagttaccgttgttccgtttaaccg

SEQ ID NO: 377576 - DNA, 678 bp, Homo sapiens
  misc_feature: GZ8MTXP01AZHK8.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctctgcaggtctagtcaaggcctctatatagtagatggaaactactattagaattggttcagcagacggccaggccaatctaccaagaccgtacttaaatttagttaacggtttacctaaaccggggacttccggtacgggggtacccaaggtacctagtacttcgaaggtccggacgtaaagggttcgggaacacgggtcctaaaccgttggtaactttaccgaactacgtagtaaacttaaacggtcggaacgtaagggggtggaagggtctagggtaggtattgggtttacgggtttttattaacgtggtacgtagttacgacgtaaacggtacacgtacggttcggccgtaggggtaccgttccgggacggaaacgggtaaccgaaggggttaagaaacgttaacgaaaaccgttagttcgggttacgccctagaaccgtacctaggttctaagtttccgtccg

SEQ ID NO: 377577 - DNA, 637 bp, Homo sapiens
  misc_feature: GZ8MTXP01CV2VK.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctctgcaggtctagtcaaggcctctatatagtgataggaaacactattgaattggttcagcagagccagccaaatctaccaagacgtaccttaaatttacgtaacggtttaccgtaaaccgggtacttcgtcgggggtacccagacagtattcgaggcggacaagggttgggtcgaggctacgtgtactttcaacactagaattaagtcgaacgtaggggtaggaggtcgtaggtagggtatttgggtttagggtttattacgtggactagtagacgtaaaggtacacgtacgtcggtccgttaggggtaccgttcgggaaccggtaaacggggaaccgaaaggggttaacgaaacgttaaaccgaaacggttacgttggttacgggtctacggccctaacgtacttcgttaacgttccgttaacc

SEQ ID NO: 377578 - DNA, 593 bp, Homo sapiens
  misc_feature: GZ8MTXP01DH3N4.51.86.H09.1.454.CMB.2.raw
  modified_base (389)..(389): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatggaaacacctacttgaattggttcagcagaggccaggcccaaatctaccaagacgaccttaaatttataaaggttttctaaaccggggactcgtggggtcccagacagatcagcgcaagtgggtcaggcaactgaatttcaanactagataaatcgacgaggggtggaagggcttaggaggtattggttagggttttatttaacgtgggactatagacgaaaggtaacgaacaacgtacggtccgtcgggtacggtacgggtaccggaaacgggaaaccggaaacgggtaaggaaagtaaacgaaacgaaacgttagttaggcgtgaacgacacttactgttcgttc

SEQ ID NO: 377579 - DNA, 570 bp, Homo sapiens
  misc_feature: GZ8MTXP01DBAWY.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaagcctctatatagtgatagaaacactacttgaattgtcagcagagcagccaatcacagacactaattataagttctaacggtactcgcgggtccagacagtactccagcgcaggtggtacaggcactgtactttcactactagataatcgaacgtagggtaggaaggcgtaggaggtagtttggtttagggttttaatacgttagactagttcgacgtaaacggttacacgtacgtggtccgtagggtacgttcggaacgaacgggaccgtaaagggtagaaagtacgaaacgtaacgtggttaggcttagaaccactaactctacgttcttcgaacttcccg

SEQ ID NO: 377580 - DNA, 593 bp, Homo sapiens
  misc_feature: GZ8MTXP01C8A9O.51.86.H09.1.454.CMB.2.raw
  modified_base (271)..(271): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgccccgtcacccttggacagcccggctccatcctcctgcaggtctagtcaaggccctctatatagtgataggaaacncctacttgaattggttcagcagagccaggccaatctacaagacgtaccttaattataaggtttacaaccgggactccgtcggggtcccagacagattacagcggcaagggtgggtcagggacactgtatttcactactgaacttaaagtcgaacgtagggtgggaaggtcgtaggaggtagttggggtttaggggtttttattacgtgactagttgacgtaaaggtacacgtacgtcggcgtaagggtacgttccgggacgaagggaaaccgtaagggttaacgaaattacgaaaacgtactggtagcttacgcaacgtaac

SEQ ID NO: 377581 - DNA, 678 bp, Homo sapiens
  misc_feature: GZ8MTXP01D7VVF.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaactacctacttgaattggtcagcagagccagccaatcacaagcgacttaatttataaggtttctaacgggacttcgtcggggtcccaagacagacttccgaggtcggcgaggtcgggtaccagggctacgtgtaatttccaactactagtaaactaaagtcggaacggaagggggtgggaagggtcgttagggaagggttagtttgggtttacggggttttaacttaacgttggtactagggttacggtaacgtaaacgggttacaacgtaccgtgggtacccgttagggggtaccgttaccggggaaccgaaacggggaaccgtaaaaggggttaggaaaattaccgaaaacgtaaaccggttggttcgggttcttacggaacctaaccgttaacgttcgttcgttacctttaacgttccgttcccg

SEQ ID NO: 377582 - DNA, 587 bp, Homo sapiens
  misc_feature: GZ8MTXP01DROU1.51.86.H09.1.454.CMB.2.raw
  modified_base (427)..(427): a, c, t, g, unknown or other
  modified_base (460)..(460): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtcctccactcctccctgcccgtcacccttggacacgccggcctccatctcctgcaggtctagtcaaggcctactatatagtgataggaaacactattgaattggttcagcagacggccaggcaatcacaagacgtactaatttataaggtttcaacggctcgtcggggtacccagacagtatacagcgcaggtgggtcaggctacgtgtatttcactactagtaataactacggagagggtggagntggagtattggggttttagggtttattacgtgntagtgagaacggtactaacgtcgtacgggccgttggggtaaccggttcgggaccggaaacgggaaccgtaagggttaagaaacttaccgaaaacggaatggtaggcgttagaaccgttaacgtaacg

SEQ ID NO: 377583 - DNA, 636 bp, Homo sapiens
  misc_feature: GZ8MTXP01EKB85.51.86.H09.1.454.CMB.2.raw
  modified_base (617)..(617): a, c, t, g, unknown or other
  modified_base (630)..(630): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagcccgcctccatctcctgcaggtctagtcaacggcctctatatagtgataggaaactactacttgtaattgtacagcagagccaggccaatctaccaaagtacgtaccttaaatttacgtaaaggtttaccgtaaccgggtcttcgtacgggggtaccccaagaacagtaattccgacggtcggactaagggtcgggtaacgacgggtctacgttgtaactttcaacgtactagtaaattaacgtacggaacggtaggggtggaggacttagggtaaggttagtttgggttttacgggtttatacgttagactagtagaacgtaaggtaccacgtacgtcggtcgtaggggtccgttacggacgaacgggaccaagggtacgaaatacgaaacgaacgttgcggcttagccactgttacncgttctttaaccncgtccg

SEQ ID NO: 377584 - DNA, 753 bp, Homo sapiens
  misc_feature: GZ8MTXP01ASUN8.51.86.H09.1.454.CMB.2.raw
  modified_base (200)..(200): a, c, t, g, unknown or other
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacngccggcctccatctcctgcaggtctagtcaaggcctctatatagtgatggaaacncctattgaattggttcagcaggacgccaggccaaatcctaccgaagtacgtccttaaatttagtaacgggtttacctaaaccggggtcttccggttacgggggtaccccaaggtaccaagtagtttcgaaggtcccggggtacgtaaacggggttcggggtccaaggggtcctaaacgttacgggtaactttttaccaaacgtaaccgttagtaacttaaaacggtcggaaacgtagggggttagggaacgggtctagggtaaggggtagtttgggttttaaggggtttttaacttaccgtagggtacgttaagttacggacgtaaaacgggtcctacgtacggttcgggtcccgtagggggtaaccgttaccggggaaccccggtaaaagggggaacccgttaaaggggaacggaaaccgtaacggtaaaaaccggttacgttggttacgggaactacggaaccctaacggtacttaccgttcggttcctttaaccg

SEQ ID NO: 377585 - DNA, 568 bp, Homo sapiens
  misc_feature: GZ8MTXP01DES71.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacactacttgaattggttcagcagaggccaggccaaatctccaagacgcctaaatttataaggtttctaaccgggactcgtcggggtcccagacagattcagcgcaagtgggtcaggcactgatttcacactgataatcgagagggtggaggcgtgaggagtgttgggtttagttacgttggtcgtagtgtacgaaggtaacgacacgtacggtccgtcgggtacggttcggccggaaacgggaaccggaaggtaggaaagtaacgaaacgaaacgttagttaggtcgtacgcgaccattactcgttcgtttccg

SEQ ID NO: 377586 - DNA, 566 bp, Homo sapiens
  misc_feature: GZ8MTXP01ECT8Y.51.86.H09.1.454.CMB.2.raw
  modified_base (254)..(254): a, c, t, g, unknown or other
  modified_base (276)..(276): a, c, t, g, unknown or other
  modified_base (324)..(324): a, c, t, g, unknown or other
  modified_base (436)..(436): a, c, t, g, unknown or other
  modified_base (533)..(533): a, c, t, g, unknown or other
  modified_base (548)..(548): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcagtctagtcaaggcctctatatagtgataggaaacncctattgaattggttcagcagngccagccaatctcaagcgtacttaaatttataaggtttcaaaccgggnttcgtacggggtacccagactagtattcgagcggcaagggttgggtcaggcattgatttcactactgaataagtcgagagggtgaggctggagtattgttaggtttatacgngtcagtgacgaagtacacgtgtacggcgtgggtacgtcggaccgaagggaccaaagggtaggaaaactacggtaaaacgttacgttggttacgggtntacggctaacccgtnttacgtcgttcttaaccg

SEQ ID NO: 377587 - DNA, 601 bp, Homo sapiens
  misc_feature: GZ8MTXP01EIQG9.51.86.H09.1.454.CMB.2.raw
  modified_base (254)..(254): a, c, t, g, unknown or other
  modified_base (361)..(361): a, c, t, g, unknown or other
  modified_base (577)..(577): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatcctcctgcaggtctagtcaaggcctctatatagtgataggaaacncctattgaattggtcagcagcgcagccaatctaccaagactaccttaatttataaggtttcaaccgggtacttcgtcggggtcccagacagtacttccgaggcgganaggtcgggtaacagggctatgtactttcacactgaatagtcgacgaggggtcggaggacgttaggagggtatttgggtttagggttttatacgttagaccagggttcgaacgtaagggtacacgtacgtgggcccgttgggggaccgttacggaccgaaacggggacgaaagggtagaaaacgtacgaaacgacgtgttggcttaggccaacgttnttcgtcgttcttccgttcgtcccg

SEQ ID NO: 377588 - DNA, 616 bp, Homo sapiens
  misc_feature: GZ8MTXP01B7NWH.51.86.H09.1.454.CMB.2.raw
  modified_base (388)..(388): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactattgaattggttcagcagagccagccaatcacaagacgtaccttaaatttataaggtttcaaccggactcgtcggggtcccagacagatcagcgcaaggtgggcagggcactgactttcaactctaaagtntaagtccgaagaggggtaggaggtcgtaggtaggtagttggttttagggttttaattacgtggtacgtagttcgaacgtaaaggtaccacgtacgtacgggtccgtacggggtacgttccggaccggaaacgggtaaccgaaagggttacgaaacgttaacgaaaaccggttaacgttggttacgggaactacggaactacccgtattccgtcgttcccgtttaaccg

SEQ ID NO: 377589 - DNA, 714 bp, Homo sapiens
  misc_feature: GZ8MTXP01EZXXV.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctattgaattggttcagcagaggccaggccaaatctaccaagaccgtaccttaaatttacgtaacggtttcctaaaccggggtacttcgtcgggggtaccccagacctaggacttacgaaggcggacctaaagggttgggtcaaagggcaccgttggtaacttttccaactaacgttagtaaagttaacgtcggaacggtagggggttacggaaacgggtcgttagggaagggttaagttgggttttacggggtttttaaattaccgttggggacttaagttcggaacgtaaagggtaccacgtacggtcgggtcccgtaggggtaccgttcggaccgggaaacgggtaaccgttaaagggtaaggttaaactaaccggaaaaccggttaacggtttgggacggtaaccgttcggaacccgtaaccctaaggttccgttccgtttaacgtttaacccg

SEQ ID NO: 377590 - DNA, 669 bp, Homo sapiens
  misc_feature: GZ8MTXP01A94N6.51.86.H09.1.454.CMB.2.raw
  modified_base (198)..(198): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacngcccgctccatctctgcaggtctagtcaagcctactatatagtgataggaaactacttattgtaattggtcagcagacgccaggccaatctaccaagacgtacttaatttagtaaggtttaccaacgggtactcgtcggggtaccagacagattccgaggcggacgtaggtcggtacaggcactgtactttcactactagtaatagtcgaacgtagggggtacggaaggtgttagggaagggttagtttaggttttagggtttaacttacgtagtactaggtacgtaacgtaaacggttaccaacgtacgtcgggtccggttacggggtaccggttaccgggaccgaaacgggaacccgtaaagggtaacggttaaaacgtaaacgaaacggtaaaccgttggttacggaccgttacggaaccctaaacccgttcgttccgtacgtttaccttaaccgttaaccgttcccg

SEQ ID NO: 377591 - DNA, 798 bp, Homo sapiens
  misc_feature: GZ8MTXP01ER2HV.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttgacagccgcctccatctcctgcaggtctagtcaacggcctctatatagtgataggaaacactacttgaatttggtttcagcaggacggccgaggccaatctaccgaaagtaccgtaccctttaaattttaacgttaaacgggtttaccgtaaacccggggtaacgtccgttacccgggggtacccaaggtaacgaggtactttaaccgacgggccgggtacgtaaggggttcggggttacgaacggggcttaccgttagttaaccttttacgaacctacgttagtaaacgttaaacgtacccgggaacggggttaagggggtaggggtaaggggttcgggttagggggttaacgtttgggggttttttacggggggtttttaatttaacggtccggtactaaggttaccggaacggtttaaacggttaacccaaccggtaacgggttcgggtcccgggttacggggggtaaaccggttttcccggggaaaccggaaacgggggttaaaccggtaaagggggtaaacggttaaaacgttacccggaaaaggtaaccggttgcgggttactcggacctaaccgttaacttcgg

SEQ ID NO: 377592 - DNA, 669 bp, Homo sapiens
  misc_feature: GZ8MTXP01AZ1IC.51.86.H09.1.454.CMB.2.raw
  modified_base (256)..(256): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacacgccgcctccatctcctgcaggtctagtcaaggtcctctatatagtgataggaacnctatgattggtcagcaggagccaggccaatctaccaaagaccgtaccttaaatttacgtaacggtttccaaaccgggtacttcgtacgggggtcccaaggacagtattcgaaggcggcgtaagggtggggtccagggcctacgttcgtactttcaactaactgaaattaacgtcggaacgtagggggtgggaacggtcgtaggagggtagtttgggtttagggttttattacgtggtacgtagttacggacgtaaaggtaccgacgtacggttcggggccgttacgggggtaccggttccggggaaccggtaaacggggtaaccgaaaggggtaaggttaaaacgtaccggtaaaaacggttacgttcggttagggctacggaactacccgtattcgttaacgttccttaacc

SEQ ID NO: 377593 - DNA, 705 bp, Homo sapiens
  misc_feature: GZ8MTXP01A0QKO.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacacgccggcctccatctcctgcaggtctagcaagcctctatatagtgataggaaactactattgaattggttcagcaggacgccaggccaaatcctaccaagaccgtaccttaaatttacgttaacggtttccaacccgggtactcggtacggggtacccaagacctagtacttacgaggccggtagaacgggttggggtccaaggggtccctaacgttggtaactttaccgaacgtaacgtaggtaaacttaaacggtaccggaacgggtaagggggttacggaacggggtcgttaggggtaagggttagtttggggttttagggtttttaataccgttgggggtactaggtacgtaacgtaaacggtacgacgtacggttcgggtaccgtagggggtaccgttccggggaaccggaaagggtaaccgaagggttaacggaaactacggaaaacgttagttggttacggtctacggaacacccgtattcccgtgttccgttaacg

SEQ ID NO: 377594 - DNA, 665 bp, Homo sapiens
  misc_feature: GZ8MTXP01DLINR.51.86.H09.1.454.CMB.2.raw
  modified_base (212)..(212): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacncgccgcctcatctcctgcaggtctagtcaaggcctctatatagtgatacggaaactacctattagaatttggttacagacagacggccaggccaatcaccaagacgtacttaaatttacgtaaggtttaccaaacgggctcgtacggggtcccaagacagatcgaggcggctagggtgggtcaggcactgtactttcaactacgtagaattaagtacggaacgaggggtggaaggtcgtaggtaaggtagtttagggggttttaggggtttttaacttaacgtgtacgtagttcggaacgtaaacgggtacaacgtacggtcggggtccggttaacgggggtaccggttaccgggtaaccgggaaaggggtaaacccggtaaagggttacggttaaaacgttaacgaaaacggtaacgtcggtgggtaccttacggtaaccgttaaccttaag

SEQ ID NO: 377595 - DNA, 637 bp, Homo sapiens
  misc_feature: GZ8MTXP01C3QI0.51.86.H09.1.454.CMB.2.raw
  modified_base (198)..(198): a, c, t, g, unknown or other
  modified_base (321)..(321): a, c, t, g, unknown or other
  modified_base (332)..(332): a, c, t, g, unknown or other
  modified_base (345)..(345): a, c, t, g, unknown or other
  modified_base (372)..(372): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacngccggcctccatctcctgcaggtctagcaaggcctctatatagtgataggaaactacctattgtaattggtcagcagagccaggccaatcacaagacactaatttataagttcaacggctcgngggtccagacngacttcgagcggnaggtggacaggcatgtattcactactnaatatcgagtaggggtggagtcgaggtaggttagtttagggtttgggtttaatacgtaggtactaaggggttcgaaccggtaaaaggttacccacgtaaccgttcgggtaccgttacgggggtaaccgtttaccgggaaccggaaacgggggtaacccgtaaaaagggggttcgaaaaacgttaccgaaaaccggtaacgttggggttacgggttcttacggaacccaagttaacttcgtcgttaccttcttaacgtttcccccg

SEQ ID NO: 377596 - DNA, 581 bp, Homo sapiens
  misc_feature: GZ8MTXP01BUWQA.51.86.H09.1.454.CMB.2.raw
  modified_base (345)..(345): a, c, t, g, unknown or other
  modified_base (560)..(560): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcaccttggacagccgcctccatctcctgcaggtctagtcaaggcctctatatagtgataggaaacaccttattgaattggtcagcagagccaggccaatctaccaagacgaccttaatttataaggtttccaaaccgggtctcgtcggggtccagacagntccgagcggcaggtgggtacagggtcaacgtggtaactttccaactacgtagtaactaaagtcgaacggtagggggtggaaggtcgtaggaggtattgggtttacgggtttattacgtgcagtgacgtaaggtcagtacgtcggcgtgggtacgttcggacgtaagggaccgaagggtaggaaactacaaacgtacgtggttcgcttgctaccgntctcgttacttcaacttcccg

SEQ ID NO: 377597 - DNA, 697 bp, Homo sapiens
  misc_feature: GZ8MTXP01ANPYZ.51.86.H09.1.454.CMB.2.raw
  modified_base (256)..(256): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccgttggacagccggcctcatcctcctgcaggtctagtcaagcctctatatagtgatggaaacncctattgaattggttcagcagacgccaaggccaatcctacaagacgaccttaaatttagtaacggtttcaaaccgggtacttcgtacgggggtacccaggtaccaagactttacgaacggccgggtactaaaggggttcgggtccgaaaggggtcctaacgtaggtactttacgaactacctagtaataagtccggaagaggggttaggaaggtcgtagaggtattgggtttaggtttattacgtggggactagtacgaacgtaaacggtacacgtacgtacgggccgttagggggtaccgttccgggaacccggtaaagggtaaccccgaaagggggttaaacggaaaacgttaaaccggaaaacggttaaccgggtttgggacggtaaccgttacggaacctaaaccccggttcgttaccgttaacgttccgttaaccg

SEQ ID NO: 377598 - DNA, 599 bp, Homo sapiens
  misc_feature: GZ8MTXP01A00I4.51.86.H09.1.454.CMB.2.raw
  modified_base (355)..(355): a, c, t, g, unknown or other
  modified_base (409)..(409): a, c, t, g, unknown or other
  modified_base (414)..(414): a, c, t, g, unknown or other
tcagcgatcgtatacacgaccggtgctcgatttagtgctatagacttgggtttggggactgatcaggactcctcagttcaccttctcacaatgaggctccctgctcagctccgtggggctgctaatgctcgtgggtcccaggttccaggtggggatgttgtgctgactcagtctccactcctccctcgcccgtcacccgttggacacgcccgcctccatctcctgcaggtctagtcaacggtcctctatatagtgatagaaactcctattgaattggtcagcagacgcagcaatctacaagcgtactaatttataggtttcaacggtctcgtcgggtaccagacacatcgagcgnaagggtggtcagggctactgtacttacactactagaataagtcgaggtaggggnggagngtaggaggttattgggtttacggtttaatacgtggtacaggttacgaacgtaacggtacacgtcggtcggggtcgtacgggggtaccgttaccggggaacgtaaaggggaacgttagggtaaacgaaactaacggaaacgttagttcggttgaacctggtaaccacgtcttcggtcttcgtaacc

SEQ ID NO: 377599 - DNA, 608 bp, Homo sapiens
  misc_feature: GZ8MTXP01E3O17.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgccccgtcacccttggacagccgcctccatctcctgcaggtctagtcaaggtcctctatatagtgatggaaacactacttgaattggttcagcagagccaggccaatctaccaagacgaccttaaatttacgtaaggtttccaaccggggtctcgtcggggtacccagacagtatcgagcggcaggtggggtcagggtcactgtactttcaactactgaatagtcggaacgtaggggtggaggtcgtaggaggtagttggggtttaggggtttttaatacgtaggactagttaggacgtaaagggtacacgtacgtgggcccgtggggtacccggttacggccggaaagggaccgtaaagggttacggaaaacttacgaaaacgacgtggtacggcgttagaaccaacgtaacg

SEQ ID NO: 377600 - DNA, 553 bp, Homo sapiens
  misc_feature: GZ8MTXP01DERSU.51.86.H09.1.454.CMB.2.raw
  modified_base (281)..(281): a, c, t, g, unknown or other
  modified_base (284)..(284): a, c, t, g, unknown or other
  modified_base (286)..(286): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatagaaacactattgaattggtcagcagagcagcatcncancnctaattataagttcaacggactcgtcgggtaccagacagattccagcggcaggtggtacaggcatgtattcacactagactaatcgaacgaggggtggagtcgtaggaggtattggtttacgggtttatacgtgtacaggttcgacgtaaaggtacacgacgtgggccgtaggggacttccgggaccgaaacgggacgaaagggtagaaatacgaaacgtaacgtgcgcttacgaaccactaattctagttcctcgaactttccccg

SEQ ID NO: 377601 - DNA, 563 bp, Homo sapiens
  misc_feature: GZ8MTXP01DE2EJ.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctattgaattggttcagcagagccaggccaaatctaccaagacgtaccttaaatttataaggtttcctaaaccgggctcgtgggtcccagacagattcagcggcaaggtgggtcaggcatgatttcgacactgataatcgacgagggtggaggctggaggtagttgtttgggttttaattacgtggacgtaagttcgacgtaaggtaccacgtacgtcggccgttgggaccgttcggacgaaagggaccaaagggtagaaacgtacgaaacgaacgttgttaggctagcactagttcttgttctttc

SEQ ID NO: 377602 - DNA, 616 bp, Homo sapiens
  misc_feature: GZ8MTXP01ESXAU.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcaccttgacagccgcctcatctcctgcaggtctagtcaaggcctctatatgtgatgaaacactattgaattggttcagcagagccaggccaatctacaagacgtaccttaaatttacgtaaggtttacaaccgggtctcgtcggggtcccagacagattacgagcggcaggtgggtcagggctacgtgtatttcactactagaattaagtacggaacgaggggtaggaggacgttagggaagggtagtttgggggttttagggtttttaacttacgtgtacgtagtcggactaaagggtactaacgtacgtcgggtcccggtaaggggtaccgttacgggaccgttaaacgggaccgtaaagggttagaaaacgttcgaaaaccggtagtgtcggacgttcgtaaccgaactaacg

SEQ ID NO: 377603 - DNA, 729 bp, Homo sapiens
  misc_feature: GZ8MTXP01C6ZN7.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgatggaaactactacttgaattggttcagcagaggccaggccaaatctaccaagacgtacttaaatttagtaacggtttccgtaaccgggactcggtacgggtacccagaccagtacttcgaggccggacgtaagggttggggtcaagggtcctaacgttgtaacttttacaaactacgtagtaaattaacgacgggaagggtaagggggttagggaaagggtcgtttaggggtaaaggggttagttttagggttttacgggggttttttaaattaaccggtgggggttaacctaggtttacggaaccgtaaagggttaccaaaccggtcggtttcggggtcccggttagggggtacccggttaccgggaaccggaaaacgggggtaaccgttaaaagggggtaacgaaaacttaacggaaaacggttaaccgttgggttaacgccgtacgcctaaaccgttagtttccgttcgttccgttaacc

SEQ ID NO: 377604 - DNA, 608 bp, Homo sapiens
  misc_feature: GZ8MTXP01EGZJM.51.86.H09.1.454.CMB.2.raw
  modified_base (584)..(584): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatggaaactctacttgaattggttcagcagaggccaggaccaaatcctaccaagacgtaccttaaatttagtaaggtttctaaccggggcttcgtggggtacccagacagattcgagcggcaaggtgggtcaggcactgtactttcactactgaataacgtcggacgtaggggtggaggtcgtaggaggttagttggtttagggttttaatacgttgggctaagttcgacgtaaaggtacaacgtaggtcgggtacccgtagggggtaccgttaccgggaaccgtaaacggggaaccgttaaagggtacggaaactaacgaaaacgttacgttgacggntacgctacagttctcgttcttaac

SEQ ID NO: 377605 - DNA, 559 bp, Homo sapiens
  misc_feature: GZ8MTXP01EX2KH.51.86.H09.1.454.CMB.2.raw
  modified_base (293)..(293): a, c, t, g, unknown or other
  modified_base (336)..(336): a, c, t, g, unknown or other
  modified_base (441)..(441): a, c, t, g, unknown or other
  modified_base (466)..(466): a, c, t, g, unknown or other
  modified_base (522)..(522): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagcccggcctccatcctcctgcaggtctagtcaagcctctatatagtgataggaaactacctattgaattggtcagcagagcagcaatcacaagcncttaattataacggttcaaccggctcgtcggggtccagacagntccgaggcgcagtgggtacagccgatgtattcgaacacttagaataacgtcgacggtaggggtaggaggctagggaggttagttgggtttagggtttaattacgngtacagtggaaccgaagttacgacngtcggcgtgggacgtcggacgaaggaacgaaggtagaaactacgaaacgtaagtgngcgttcgaacactaattctcgttcttaacgcgtcccg

SEQ ID NO: 377606 - DNA, 662 bp, Homo sapiens
  misc_feature: GZ8MTXP01CQ977.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcttccatctcctgcaggtctagtcaaggcctctatatagtgataggaaacacctacttgaattggttcagaagaggccaggaccaatctaccaagacgtaccttaaatttagtaacggtttctaacccgggtactcgtggggtcccagacagtactcgagcggcaggtcggggtcaacgggtcaaacgttggtaatttaccgactaacgtaggtaattaaacgtaccgggaacggtagggggttacgggaggggtacttaggggtaagggtaagtttggggtttaggggttttaatttaccgtgtacgtagttgtaacgtaacgggttaccacgtacgtcgggtacccgtagggggtaccgttcgggacccgaaggggaacccgaaagggttacggaaacttacgaaaacgacgttaggttcgacgtaacgccaactagtcttacgttcttcgtaac

SEQ ID NO: 377607 - DNA, 831 bp, Homo sapiens
  misc_feature: GZ8MTXP01EU0HT.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacacgccgcctccatctcctgcaggtctagtcaaggcctctatatagtgatggaaacactacttgaattggttcagcagacggccaggccaatctaccaaagaccgtacctttaaattttaagtaacggttttaccaaaccggggtacttccggttaccgggggtaccccaaaggacctaaaggtactttaccgaagggtcccggggtacgtaaagggggttcggggttaccgaaggggtacctaacgttaggttaacttttaccgaactaacgttaggtaaacttaaacggtacccgggtaaacgggtaaggggggttagggaacggggtacgttaggggtaaaggggttcggtttttaggggggtttttagggggtttttttaaacttaaccggttagggtaccgtaagtttacgggaaaccgttaaaacgggttaccgtaaccgtaacccggttcgggggtccccggttaacggggggtaacccggtttacccgggggaaacccgggttaaaacgggggtaaaccccgggttaaaaaggggttaacgggggttaaaaacttaaccgaaaaacgggtaccgttaagggttacggacgttacgaaccgttaaacccgttcg

SEQ ID NO: 377608 - DNA, 537 bp, Homo sapiens
  misc_feature: GZ8MTXP01ENXXY.51.86.H09.1.454.CMB.2.raw
  modified_base (200)..(200): a, c, t, g, unknown or other
  modified_base (278)..(278): a, c, t, g, unknown or other
  modified_base (430)..(430): a, c, t, g, unknown or other
  modified_base (433)..(433): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacngccggcctccatctcctgcaggtctagtcaaggccctctatatagtgatggaaacacctattgaattggttcagcagngccaggccaatctcaagacgtctaatttataaggtttcctaacgggactcgtcgggtcccagacagtattcgagcggcaaggtgggtcaaggtcactgtatttcactactgatatcgacgagggtggagctggagtattgttggtttatacnggnatgacgaaggtacacagtggcctggggacgttcggacgtaaagggaccaaagggtagaaagtcgaaacgacgttgttacggctggcaccattcgtcgttcttcc

SEQ ID NO: 377609 - DNA, 593 bp, Homo sapiens
  misc_feature: GZ8MTXP01A9LWK.51.86.H09.1.454.CMB.2.raw
  modified_base (383)..(383): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagacggccaggccaaatctaccaagacgcctaaatttataaggtttctaaccgggactcgtggggtacccagacagattcagcgcaagtgggtcagcatgatttcacnctagataatcgacagggtggaggctgaggattgttagggtttacttatggggctatgacgaaggtcacgtacgtggccgtgggtaccgttcgggcccgtaaaggggaacccgttaaagggttacgggaaattaccgaaaacgggttaaaccgttgggttcgggaacccgttaggccgtaaccccgtaattacgttcggtttcctttcccg

SEQ ID NO: 377610 - DNA, 617 bp, Homo sapiens
  misc_feature: GZ8MTXP01CCF7V.51.86.H09.1.454.CMB.2.raw
  modified_base (611)..(611): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggccctctatatagtgataggaaacactacttgaattggttcagcagaggccaggccaatcctaccaaagaccgtacctttaaatttagtaaacggtttaccgtaaccgggactcgtcggggtcccagacagattacgagcggcagggtgggtcaggcactgtactttcacacgtagaataagtacgacgaggggtggaggcgtaggaggtagtttagggggtttgggttttattacgtgtcgtagtgacgtaaggtacacgtacgtcgggtccggttaaggggaccggttcgggaccggaaacgggtaaaccggtaagggttaacgggaaacttacgaaacggtacgtggtacgggcttacggaaccncctaag

SEQ ID NO: 377611 - DNA, 601 bp, Homo sapiens
  misc_feature: GZ8MTXP01CU3WB.51.86.H09.1.454.CMB.2.raw
  modified_base (338)..(338): a, c, t, g, unknown or other
  modified_base (366)..(366): a, c, t, g, unknown or other
  modified_base (391)..(391): a, c, t, g, unknown or other
  modified_base (395)..(395): a, c, t, g, unknown or other
  modified_base (419)..(419): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatagaaacactacttgtaattggttcagcagagccagccaatctacaagacgtaccttaattagtaaggttctaaccgggntcgtcggggtcccagacagattcagcgnaggtgggtcaggcactcgatttcanactnaataatcgtagagggtaggacgtntggagtagtttgggtttacgggttttatacgtgactagtcgactaaacgggtacaacgtaccgtgggcccgttaagggggtacccgttcggggaacccgaaaggggaacccgtaaaggggttacgaaaacgttacgaaaacgaacggtttggcgggtacttacggaaccttaacccgttaag

SEQ ID NO: 377612 - DNA, 572 bp, Homo sapiens
  misc_feature: GZ8MTXP01ASSZO.51.86.H09.1.454.CMB.2.raw
  modified_base (394)..(394): a, c, t, g, unknown or other
  modified_base (419)..(419): a, c, t, g, unknown or other
  modified_base (443)..(443): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactacttgaattggttcagcagaggccaggccaaatctaccaaagacgaccttaaattttactaaaggtttcctaaaccggggactcgtggggtcccagaccagattcagcggcaaggtgggtcagggcactgatttcanactgataatcgacgaggggtgaggntgaggattggttacggtttatacnggcaagtgacaaggtcacgacgttggcccgttggggaccgttcgggaccgaaaggggaccaaaggggtacggaaactacgaaaacgaacgttggttcggaactgcctaacctgttacctgttccttccg

SEQ ID NO: 377613 - DNA, 568 bp, Homo sapiens
  misc_feature: GZ8MTXP01CLJR2.51.86.H09.1.454.CMB.2.raw
  modified_base (257)..(257): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacacgccggcctcatctcctgcaggtctagtcaaggcctctatatagtgataggaaacnctattgaattggtcagcagagccagcaatcacaagctactaattataaggtttcaacggctcgtcgggtaccagacagatcgagcggctaagggtgggtcaggctacgtgtacttcactactagataagtcggacgaggggtaggaaggtcgtagggaaggtagttagggtttagggttttaattacgtggtactagtacgacgtaaaggtacacgtacgtacggccgtgggtacgtccggacgaaacgggacgaagggtacgaaagtacgaacgacgttggttacgctgaacactattcgtgttcttaac

SEQ ID NO: 377614 - DNA, 585 bp, Homo sapiens
  misc_feature: GZ8MTXP01DDAD1.51.86.H09.1.454.CMB.2.raw
  modified_base (252)..(252): a, c, t, g, unknown or other
  modified_base (284)..(284): a, c, t, g, unknown or other
  modified_base (291)..(291): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatagaaacnctattgaattggtcagcagagccagccaatcncaagacnctaattagtaagttcaacggctcgtgggtccagacagattccagcgacaggtgggtacaggcactgtactttacacactgaactaaagtcgaacgtaggggtggaggcgtagggaaggttgtttgggtttagggtttatacgtgtacaggtacgacgtaagtacacacgtcggcgtagggacgttcggaacgaacgggaacgaaagggtacgaaactacgaaacgtaaacgtggttacgttcgacgtaacctaaaccgtcttacgttcgttaccttaacgttaacgtttccccg

SEQ ID NO: 377615 - DNA, 619 bp, Homo sapiens
  misc_feature: GZ8MTXP01C6DC3.51.86.H09.1.454.CMB.2.raw
  modified_base (274)..(274): a, c, t, g, unknown or other
  modified_base (412)..(412): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacagccggcctccatcctcctgcaggtctagtcaaggcctctatatagtgatgaaactctattgaattggttcagnagacgcaggccaatctaccaagacgtaccttaatttaagtaaggtttaccgtaaaccgggctcgtacggggcccagactagattacgagcgcaagggtggtcaggcactgattcacatgatagtcgagagggtgaggngtaggtaggtagttcgttagggttttatacgttggactagtagacgtaaaggttacacgtcgtacgggtccgtgggggtaccgttccggggaccgaaaacgggtaaccgaaagggggtacggaaaacttaacggaaaacggttaaccgttggggttaacgtcgtacggaaccgtaacccgttagttactttaacgttccgtttaacg

SEQ ID NO: 377616 - DNA, 655 bp, Homo sapiens
  misc_feature: GZ8MTXP01CYW0M.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacacgcccggcctccatctcctgcaggtctagtcaacggcctctatatagtgatagaaactactattgaatttggttcagacagacggccagccaatctaccaagaccgtacttaattaacgtaagtttccgtaacggctcgtcggggtacccagtacagtactcgagcggcaagggtcgggtcgaggctacgttagtaactttcaactacgtagtaataacgtccggagtagggggtgggaaggtctagggtaagggtattgggtttagggttttaatacgtggtactaagtacgtaacggtaaggtaccacgtaccggttacggaccggttcgggggaaccgttccggggaaaccggaaacgggggtaacccgaaaggggttaaacgaaacgttaacggaaacgttaacgttggacggaactacgcctaccgtattccgttaacgttcgtaaccg

SEQ ID NO: 377617 - DNA, 686 bp, Homo sapiens
  misc_feature: GZ8MTXP01D83NI.51.86.H09.1.454.CMB.2.raw
  modified_base (401)..(401): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtcctccactcctccctgccccgtcacccttggacacgcccggcctccatctcctgcaggtctagtcaacgcctctatatagtgatacggaaacacctacttagtaatttggttcagcagaggccaggaccaactccaccaagaccgtacctttaaatttaagtaacggtttacgaaccgggtctcgtccggggtacccagactagtacttacgaggccggngagggtgggtcgaggctacgtgtactttacactactgtaataagtcggaacgtagggtaggaggtcgtggtaagggttgtttaggggttttacgggttttaattacgttggactagtgaacgtaaacggtcgtaacgtcgtcgggtcggtaacggggtaccggttaccggggaaacccggttaaagggtaaacccggtaaggggttaaaccggaaaacgttaaccggaaaacggtaaccggttgggtaccgggtacgttaccggtaacccttaaccggttaaccg

SEQ ID NO: 377618 - DNA, 728 bp, Homo sapiens
  misc_feature: GZ8MTXP01BLARK.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactcctccctgccccgtcacccttggacagcccggcctccatctcctgcaggtctagtcaaggccctactatatagtgataggaaacctacctattgtaatttggttacaggcaggacggccaggaccaatcctaccgaagtaccgtacctttaaattttagtaacggtttacctaaaccgggtacttccgtaccgggggtaccccaaggaacctagtacgttaccgaaggccgggtcgtaaggggttcgggggtaccaacggggtactacgttgtaacttttacgaacctacgtaggaattaaacgttaccggaaggtacgggggtagggaagggcgtaggagggttaagtttgggggttttagggtttttactacgtggtactagtagtacgaaaggttcaaccgtacgtcgggaccggttcgggggtaccgttaccggggaacccgaaagggggtaaacccgtaaagggttaacggaaaacgttaaccgaaaacgggtacgttggggttacgaccgttacggtaaccttaaccgttaacg

SEQ ID NO: 377619 - DNA, 635 bp, Homo sapiens
  misc_feature: GZ8MTXP01CMY7V.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaagcctctatatagtgataggaaactacctattgaattggtcagcagagccagccaatctacaagacgaccttaatttagtaacgtttcgtaaccggtcttcggtcggggtacccagactagtacttccgaggtcggcgtaggtgggtacagggcacgttgtactttacactactagaataacgtccggaagtaggggtggaaggtcgtaaggtaggtagttggtttagggtttactacgtgactagtgtaacgtaaggtacacgtacgtcggccgtacggggaccgttaccgggaccgtaaagggaacccgaaaggggtaacgaaacgttaaccgaaaacggtaaccgtggttcgggcgttacgaacccaaccgtaacgttccgtagttcccttcgttaacgttccccg

SEQ ID NO: 377620 - DNA, 618 bp, Homo sapiens
  misc_feature: GZ8MTXP01DZF6H.51.86.H09.1.454.CMB.2.raw
  modified_base (383)..(383): a, c, t, g, unknown or other
  modified_base (612)..(612): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtctccactctccctgcccgtcacccttggacagccggcctccatcctcctgcaggtctagtcaacggcctactatatagtgaataggaaactacctacttgaatttggttcagcagagccagccaatctacaagacgtacctttaattagtaacggtttctaaacgggctcgtcggggacccagacagtattacgaggcggntaagggtgggtacacgggctacgttgtatttacacgactagaataacgtacgacggtaggggtaggaggcgtaggaaggtagtttagggggtttttagggttttaacttacgtgacgtagtgaacgtaaaggtaccacgtacggtggtcccgtaaggggtaccgttcgggaccgaaagggtaaccgaagggttaggaaacttaccgaaaagacgtgtagcttacgaacnccgtaa

SEQ ID NO: 377621 - DNA, 593 bp, Homo sapiens
  misc_feature: GZ8MTXP01A6SUZ.51.86.H09.1.454.CMB.2.raw
  modified_base (364)..(364): a, c, t, g, unknown or other
  modified_base (574)..(574): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagccgcctccatctcctgcaggtctagtcaaggcctctatatagtgataggaaacacctattgaattggttcagcagacggccaggccaaatcaccaagacgtaccttaaatttagtaacggtttccaaccgggtctcgtcgggtacccagacagattcagcgnaaggtgggtcaggcactgtacttcacactgataatcggaacgaggggtggaaggctagggtaggtagttaggtttagggttttattacgtggtctagtcgacgtaaggtaccacgtacgtcgggtccgtggggtaccgtcggaaccggaaagggtaccgaagggttagaaacgtacgaaacgacgttgggttcgaagtcgaaccaacgtnttcgttaacgttccttaac

SEQ ID NO: 377622 - DNA, 804 bp, Homo sapiens
  misc_feature: GZ8MTXP01CFPRQ.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctcctatatagtgataggaaactacctacttgaattggttcagcaggaggccaggccaaatcctaccaaagaccgtacctttaaagttttaacgttaaacgggttttacccgtaaacccgggggacctttaccggttaccggggggttacccccaaagggaaccgtaacggtaacgttttacggaacgggtcccgggggtacgtaaacgggggttcgggggtaacccgaaggggtaccctaacgttacgggtaactttttaccgaacgtaaccgttaggtaaacttaaacggtacgggtaaccggtaaggggggttacgggaaggggtaccgttagggtaaggggttaagtttcgggttttaagggggtttttaactttaaccgttggggtactaggtcgacgtaaagggtaccacgtacgtcgggcccggtaggggtaccgttaccggggaccgaaacgggggtaaccgttaaaggggtaacggttaaacgttaaaccgaaaacggttaaccgttgggttacggtccgttacggaaccctaccggtattccgttggtttcctttaacccg

SEQ ID NO: 377623 - DNA, 646 bp, Homo sapiens
  misc_feature: GZ8MTXP01AZSKQ.51.86.H09.1.454.CMB.2.raw
  modified_base (447)..(447): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagccgcctccatctcctgcaggtctagtcaaggcctctatatagtgatggaaactctacttgaattggttcagcagaggccaggcccaaatcctccaaagaccgtaccttaaattttaagtaacggttttacctaaacccggggtcttcggtacgggggtaccccagacacgtacttacgaggccggcaagggtcgggtcagggcactgtactttcactactgaataatcggacgagggtggacggntaggagggtagttggtttagggttttaacttacgtgggtactagtcgacgtaaaggtaccacgtaacgttcgggaccgttcgggggaccggttacggaccggaaacggggacccgaaaggggtacgaaacgttaacggaaaacgttacgttcgggttcggaacgtacgccctaacgtacgttcgtcgttcccttaaccg

SEQ ID NO: 377624 - DNA, 682 bp, Homo sapiens
  misc_feature: GZ8MTXP01ENJMQ.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctcatctcctgcaggtctagtcaaggcctctatatagtgatggaaacactattgaattggttcagcagaggccaggccaatctaccaaagacgtaccttaaattttaacgtaaggtttacctaaaccgggtctacggttacgggggtaccccaaggacctaagtacgttacaagggtccggacgtaaacgggttgggtaacacgggtctaacctggtaacttttacaacgttactagtaactaaagtcggacgagggttagggaacggtgtaggaggtagttgtttagggttttaatactaggggtactaagttggtaaaccgtaaaggttaccaaacgtcggttacggcccggttaggggtaccggttccgggaacggtaaacgggaaccgttaaagggtaacgaaacgttaacgaaaacgttaacgttggttacggaacgttacgaacgtacctattaccgtgttaaccttcc

SEQ ID NO: 377625 - DNA, 630 bp, Homo sapiens
  misc_feature: GZ8MTXP01EWEOC.51.86.H09.1.454.CMB.2.raw
  modified_base (468)..(468): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactcctccctgcccgtcacccttggacagcccggcctccatcctcctgcaggtctagtcaaggcctctatatagtgataggaaactactattgaattggttcagcaggacgccaggccaaatccaccaagaccgtacttaaatttagtaaggtttccgaaaccgggtctcgtcggggtaccagacagtattcgagcgcgaaggtgggtcagggcacgtgtaactttcatacgtagaataagtcggagaggggtaggaggctaggaggtattcgggtttaggttttaaacttcgngggactagtcgacgaacggtacacgtacggtcgggtcgtacggggtacggtccgaacggtaaagggtaccgttaaagggttacgggaaaactaacggaaaacgaagttgggttacggtcctagtaacccgacttacgttccgttcggtttaaccttaacccg

SEQ ID NO: 377626 - DNA, 687 bp, Homo sapiens
  misc_feature: GZ8MTXP01BL4WT.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagccgcctcatctctgcaggtctagtcaaggcctctatatagtgataggaaacacctattgaattggttcagcagagccaggccaatctacaagacgtacttaatttagtaaggtttcaacggctcgtcgggtaccagacagatcgagcgcgaagggtgggtcagggtccacgttgtaactttacaactactagaattaagtcggaacggtagggggtagggacggtacgtagggtaagggttagtttagggttttagggtttttaacgttaacgtggggtactaaggttacggtaaccgtaaagggttaccaacgttaccggttacggggtcccggttaagggggtacccgtttaccgggaaccgggaaaacggggtaaacccgttaaagggggttaacgaaaacgttaaccggtaaaacggttaaccgttgggttacgggccttacggaacctaacccgtagttccttcggttccttttaacccg

SEQ ID NO: 377627 - DNA, 637 bp, Homo sapiens
  misc_feature: GZ8MTXP01AV9U7.51.86.H09.1.454.CMB.2.raw
  modified_base (254)..(254): a, c, t, g, unknown or other
  modified_base (279)..(279): a, c, t, g, unknown or other
tcagcgatcgtatacacgaccggtgctcgatttagtgctatagacttgggtttggggactgatcaggactcctcagttcaccttctcacaatgaggctccctgctcagctccgtggggctgctaatgctctgggtcccaggttccagtggggatgttgtgctgactcagtcctccactcctccctcgcccgtcacccgttggaccagcccgcctccatctcctgctagtctagacaacgtcctactatatagtnatacgaaactcctatgaattggtanagcagacgcagcaatcacaagcgtacttaatttagtaggtttacaacggtctcgacggtaccagtacagtatcgagcgacaaggttggcaggcctagtagtacttcaactactagtaactaaacggtcggaaggtaggggtacggaaggtcgttagggtaggttacgtttggggttttaacggtttaactgtaggtaactaggttacgaaacgtaaaggtaccacgtacggtacgggtcggtaacggggtaccgtaccgggaaccgaaacggggtaaacttaaggggtaagaaacaaccggtaaaagttcgttggggttacaacgtacaaccgaactcttcgtaacgttccgttaacc

SEQ ID NO: 377628 - DNA, 579 bp, Homo sapiens
  misc_feature: GZ8MTXP01CAPL3.51.86.H09.1.454.CMB.2.raw
  modified_base (200)..(200): a, c, t, g, unknown or other
  modified_base (429)..(429): a, c, t, g, unknown or other
  modified_base (561)..(561): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacngccggcctccatcctcctgcaggtctagtcaaggcctctatatagtgatggaaacacctattgaattggttcagcagaggcccaggccaaatctaccaagaccgtaccttaaatttagtaacggttttcctaaccgggactcgtcgggggtccccagtacagattcgaggcggcaagggtcgggtcagggtcactgtatttcacactgataatcgagaggggtgacggngtggaggtagttggtttagggtttattacgtggggctagtgaccgaaggtacacgtacgtgggccgttgggggacgttcggccgtaaacggggacttaaagggtcggaaatacgaagacgttgttacggtcngccacattctgttcttcg

SEQ ID NO: 377629 - DNA, 714 bp, Homo sapiens
  misc_feature: GZ8MTXP01EV94N.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgccccgtcacccttggacagccgcctccatctcctgcaggtctagtcaaggcctactatatagtgatacggaaacacctacttagaattggttacagcaggacggccgaggccaatcctaccaaagtaccgtaccctttaaagttttaacgtaacggtttctaaaccggggtactcgtccgggggtaccccaagactagacttcgaggcggtacgagggtcggggtaccacggggtactacgttaggtaacttttaccaacgtaacgtaggtaaacttaaagttacccgggaacggtaaggggggttacggagggtacgtagggtaagggttagtttagggggttttaggggttttttaattaaccgttggtactagttacggtacgaaacgggttacaccgtacggtcgggccggtaaggggtaccgttaccgggacgttaaacggggaccgtaaaggttaacggttaaacttacgaaaacggtaacgtgggtacggacttacggtaaccttaacgtcg

SEQ ID NO: 377630 - DNA, 731 bp, Homo sapiens
  misc_feature: GZ8MTXP01C3Z9A.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctcatcctctgcaggtctagtcaacggcctactatatagtagatacggaaactacttacttagaatttggttacagacaggacggccaggaccaaatcctaccaaagtaccgtacctttaaagtttaacgttaacggtttaccgtaaaccggggacttccggtacgggggtacccagtaaccgtaggtacttacgaggtccggacgtaaagggttcgggtcgaagggtcctaacgttagtactttaccaaacgtactagttaaactaacggtccgggaaacggtaggggggttggaagggtcgttaggtaagggttacgtttgggttttagggttttaaataccgtgggggtaactaaggttcgaaacgtaaacggtaaccaccgtaacggtccgggtccgttacgggggtacccggttaccgggaaccggaaaacggggtacgttaaagggtaagaaacgttaaccgaaacggttaacgttggacgtaacgacgtaaccgactagttcctaacgttcttaacg

SEQ ID NO: 377631 - DNA, 607 bp, Homo sapiens
  misc_feature: GZ8MTXP01D5U3U.51.86.H09.1.454.CMB.2.raw
  modified_base (253)..(253): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctccatctcctgcaggtctagtcaagcctctatatagtgatgaacnctattgaattggttcagcagacgccaggccaaatcaccaagaccgtacttaaatttagtaaggtttacctaaccgggtacttcgtcggggtacccagacagtacttcgaggtacggcgaaaggttgggtcgagggtcctaacgtgtactttcaactactagaattaacgtcggacgtagggggtggaaggtctaggaggtattggttttgggtttaattacgtggtactagttcgacgtaacggtacaacgtcgtagggtccgtcggggtacgttccgggacgaaagggaccgttaaagggtaggaaactacgaaagttacgttgttacggctcgcacattcgtcgttcttccg

SEQ ID NO: 377632 - DNA, 622 bp, Homo sapiens
  misc_feature: GZ8MTXP01C0L42.51.86.H09.1.454.CMB.2.raw
  modified_base (244)..(244): a, c, t, g, unknown or other
  modified_base (272)..(272): a, c, t, g, unknown or other
  modified_base (421)..(421): a, c, t, g, unknown or other
  modified_base (585)..(585): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacacgccgcctcatctctgcaggtctagtcaaggcctctatatagngatagaaacactattgaattggttcagnagagccagccaatcacaagactactaatttagtaagtttcaacggctcgtcgggtccagacacgtatcgagcgcgtaaggtcgggtcagggcacgttgaactttacgactaacgtagaataagtcggaacggtaggggttgggaacggngtagggtaagggtagttgggtttacgggttttataacgtggggtactaagtcgaacgtaacggtaccactaacggtcgggtaccgtcggggtaaccggttcgggaaccggtaaacggggaaccgttaaagggtaacggttaaacgtaaacgaaaacgttaacgnggttacgctagccacctattctaacgttctttaaccg

SEQ ID NO: 377633 - DNA, 636 bp, Homo sapiens
  misc_feature: GZ8MTXP01BYUYO.51.86.H09.1.454.CMB.2.raw
  modified_base (213)..(213): a, c, t, g, unknown or other
  modified_base (229)..(229): a, c, t, g, unknown or other
  modified_base (293)..(293): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactcctccctgcccgtcacccttggacngccgcctccatctccngcaggtctagtcaaggccttactatatagtgataggaaacactacttgaatttggttcagcagngccagtcatcacaagacacttaatttataggttctacggactcgtcggggtcccagacagtacttacgacggcggcgagggtggggtacagggctactagtactttacaacgtacgtgtaaatacgttaccggaggtaggggttggacgggtcttagggtagggttagtttgggggtttacgggttttataagtgacgtgtagacgtaaagggtcctacgtacggtcgggtcccggttgggggtaaccggttccggggacccgttaaaggggaacccgaaggggttaggaaacgttacgaaaacgggtacttggggtcggacgttacgcccttaacgttaacg

SEQ ID NO: 377634 - DNA, 718 bp, Homo sapiens
  misc_feature: GZ8MTXP01B8PNH.51.86.H09.1.454.CMB.2.raw
  modified_base (689)..(689): a, c, t, g, unknown or other
  modified_base (703)..(703): a, c, t, g, unknown or other
tcagcgatcgtatacacgaccggtgctcgatttagtgctatagacttgggtttggggactgatcaggactcctcagttcaccttctcacaatgaggctccctgctcagctccgtggggctgctaatgctctgggtcccaggttccaggtggggatgttgtgctgactcagtctccactcctccctgcccgtcacccgttggacacgccgcctccatctcctgcaggtctagcagcctctatatagtgatagaaactctattgaattggttcagcaggacgccaggaccaaatcctaccaagtaccgtacctttaaagtttacgtaacggtttaccgtaaaccgggtcttcggtcgggtacccaagtaaccgtagtacttcgacggtaccggacgtaagggtacgggtcgaagggtaccctaacgttacggttaactttaccgaacgtaaacgttacgtaaagttaaacgtccgggaaagggtagggggttacgggaaacggtcgttaagggtaagggtttagtttaccggggtttttaagggttttaacttaaccggttgggacgtttaaaggtacggaaacgtaaaggtccaacggtcggtacggggtccgtacgggggtacgtccgggaaacggtaaacggggaacttaaggggttaagaaacgtaacgaacgttagttggttacgntacgctacgtattntaacgttcttaaccg

SEQ ID NO: 377635 - DNA, 596 bp, Homo sapiens
  misc_feature: GZ8MTXP01EAC0G.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgctaggtctagtcaaggccctactatatagtgaataggaaacacctattgaatttggttcagcagagccaggcaatctacaagactaccttaaatttataaggtttcaaaccgggactcgtcggggtcccaggacagtataccgagtcggcagggttcgggacagggacacgtgtactttcaacacgttagaataagtacggagaagggggtgaaggctgggaagttagttgggggttttaggtttataacgtgactattcggactaaacggtacagtacggtcggtccggtaaggggaccgttcgggaaccgttaaaggaccgaaggttacgaaagttacaaaaggatcggtgcttacgcaacgtc

SEQ ID NO: 377636 - DNA, 576 bp, Homo sapiens
  misc_feature: GZ8MTXP01C53EZ.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgatggaaacacctacttgaattggttcagcagaggccaggccaatctaccaaagacgaccttaaatttataaggttttactaaccgggactcgtgggggtcccagacacgattcagcggcaagtgggtcaggcactgatttcacactgataatcgacagggtggaggctgaggtattgttgggtttatactgggctatgacgaaggtacacgacgtcggccgtgggtaccgttcgggaccgaaaggggaacccgaagggtaggaaacgttacgaaaacggttaacgttggttacggctaggaacctacgtattccttaagttcctttaaccg

SEQ ID NO: 377637 - DNA, 745 bp, Homo sapiens
  misc_feature: GZ8MTXP01D981I.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctcccactcctccctcgcccgtcacccttggacacgccgcctccatcctcctgcaggtctagtcaacggtcctctatatagtgatagaaactctacttagaattggttacagacaggacggccacggacctaaatcctaccgaaagaccgtaccttaaaagttttaacgttaacggttttacccgtaaaccggggtacttccggttacgggggtaccccaaaggacctaaggtacttcgaaggtccggcgtaaacgggtcgggttaacgacgggtacctacgttagtaactttaccgaaacaacgttaggaaactttaaacggaccggaaacgggtggggggttagggaacgggtcggttagggaaggggttagtttacgggttttaggggttttaaacttcgtagggtacgttagtacggtaaacgtaacgggtaaccacgttacggtaccggggtccgttacgggggtaccgttacgggaaccgggaaacgggtaccgaaaagggtcgttaaaacgtacgaaaacggttacgttggttacgaactcgaacgtactattcgttcgttcgttaacc

SEQ ID NO: 377638 - DNA, 556 bp, Homo sapiens
  misc_feature: GZ8MTXP01BXS1V.51.86.H09.1.454.CMB.2.raw
  modified_base (341)..(341): a, c, t, g, unknown or other
  modified_base (393)..(393): a, c, t, g, unknown or other
  modified_base (402)..(402): a, c, t, g, unknown or other
  modified_base (443)..(443): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctccatcctcctgcaggtctagtcaaggcctctatatagtgattggaaacacctacttgaattggtcagcagagccaggccaatctcaagacgcctaatttataaggtttctaaccgggactctggggtcccagacngattccagcggcaggtggtacagggcactgatttcgactactgatatcgacngggtgagcnggagagttgttgggtttatacgtgcagtgcgaaggtcaacncgtggaccgttagggaccgttcgggacctaaacggggaccaagggtgaaagtacgaaagtaaccgtgttcggcttcggaaccaaccgtcgtctcgttcttccgaatttccccg

SEQ ID NO: 377639 - DNA, 602 bp, Homo sapiens
  misc_feature: GZ8MTXP01EOOSL.51.86.H09.1.454.CMB.2.raw
  modified_base (293)..(293): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctcgtgggtcccaggttccaggtggggatgttgtgctgactcagtctccactcctccctgcccgtcaccgttggacagccgctcatctctgcaggtctagtcaaggtcctactatatagtgatagaaactactattgaattggtcagacaggagccagcaatcacanacgtacttaatttagtaacggttactaaaccgggctcgttcggggaccctagactacgtattcgagcggactaagggtggcgacggtcaaacgttgtactttacaacgtacttagaattaagacgaggagggtagaggtatagggagtagttacgggtttaggtttaactagtagggatacggtataacgtaaggtacacgtgtccgggacgtacggggacgtcgaaccggaagggaacttagggaacgaaatacgtaaagacgttgttacggtaactagaaccgacctagttcttaacgttcttaacg

SEQ ID NO: 377640 - DNA, 804 bp, Homo sapiens
  misc_feature: GZ8MTXP01B6NSG.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatacggaaactactacttgaattggttcagcaggacggccaggccaaatcctaccgaaagtaccgtaccttaaagtttacgttaacggtttacccgtaaaccggggacgttccgtacgggggtacccaaggactacggtacttcgacggccgggtacgtaaacgggttcggggttccaggggtaccttacgttacggtaccttttacgaaccgtaaccgttaggtaaattaaccggttaccgggaacgggtagggggtacggggtaagggtccgttaggggtaagggttaaggtttgggttttaggggtttttaaacttaccgttagggggtacctaaggtttcgggaaccgttaaaacgggtaccctaaacgtccggttacggggtcccggttacgggggttaacccgggtttccggggaaacccggaaaccgggggtaaaccgttaaacgggggtaacggttaaaacgtaaacccggtaaaacgggttaaccgttgggttaacggggtccttacggaaccctaacccgtagttcccgttcggttaacccgtttccg

SEQ ID NO: 377641 - DNA, 615 bp, Homo sapiens
  misc_feature: GZ8MTXP01BC07M.51.86.H09.1.454.CMB.2.raw
  modified_base (449)..(449): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacacgccgcctccatctctgcaggtctagtcaaggcctctatatagtgataggaaacactacttgaattggttcagcaggacgccagccaatctaccaagacgtaccttaaatttagtaacggtttacgtaaaccggtctcgtcgggtaccagactagattcaggcggactaagggttcgggtcagggcctaacgttgtaactttcgaacttacgtagtaattaaacgcgaacgtaggggttagggaacggngttaggagggttacgttggtttagggtttaattcgtgggactagtgaccgaaggttccagacgtgtccgtgggaccttcgggaacgaacgggtaccgaaggtaacggaaataacgaaagttacgttggttggaactcggaacctacgtattcctgttcctttaacg

SEQ ID NO: 377642 - DNA, 574 bp, Homo sapiens
  misc_feature: GZ8MTXP01EG1T7.51.86.H09.1.454.CMB.2.raw
  modified_base (268)..(268): a, c, t, g, unknown or other
  modified_base (374)..(374): a, c, t, g, unknown or other
  modified_base (432)..(432): a, c, t, g, unknown or other
  modified_base (548)..(548): a, c, t, g, unknown or other
  modified_base (560)..(560): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactcctcccctcgccccgtcacccgttggacacgcccggcctccatcctcctgcgaggtctagtcaaggtcctactatatagtgataggaaacncctattgaattggttcagcagacgccgagccaatccacaagaccgtacttaaatttaagtaacggtttccaaaccggtctcgtgggacccagacagactcgagcgnaaaggtggcaggctatgtacttcgaactactagtaataagtcgaggagggtgaaggtntaggaggtagttggtttaggtttaatcgtgactagtgaactaaggtacacgacgtcggtccgtagggtacgtacgggacgaaaagggacaaaggtacgaaataccgaaagttacgngttgctgcactnttagtcttgttaac

SEQ ID NO: 377643 - DNA, 631 bp, Homo sapiens
  misc_feature: GZ8MTXP01EM0R4.51.86.H09.1.454.CMB.2.raw
  modified_base (267)..(267): a, c, t, g, unknown or other
  modified_base (371)..(371): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttgacagccggcctccatctcctgcaggtctagtcaaggcctctatatagtgataggaaacnctacttgaattggttcagcagagccaggccaatctacaagacgtacttaatttactaaggtttcaaccgggctcgtcggggtacccagacagtattcgagcggnaagggtgggtcagggctacgtgtatttcaacactgtaataagtacgacgtaggggtggaggtctaggagtagtttggggtttggttttaatacgttgactaagtcgacgtaaaggtaccaacgtacgttacggcccggtaaggggtacccggtttcgggaacccgaaaggggtaaacccgtaaggggttaaacggaaaacgttacgtaaaaaccgggtaacgttgggtacgggtacgttaccggtaacttaaccgtaacg

SEQ ID NO: 377644 - DNA, 626 bp, Homo sapiens
  misc_feature: GZ8MTXP01AUZXJ.51.86.H09.1.454.CMB.2.raw
  modified_base (199)..(199): a, c, t, g, unknown or other
  modified_base (236)..(236): a, c, t, g, unknown or other
  modified_base (267)..(267): a, c, t, g, unknown or other
  modified_base (353)..(353): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacctggacngccgcctcatctctgctaggtctagtcaagcctctanatagtgataggaaacaccttatgaattggtnagcaggcgccagccaatccacaagactcttaaattataacggtttcaacggtctcgtcgggtaccagacagtctcgaggtcggacngggtcggtcgacgctagagtacttacactactagaatacgacgacggtagggtgaggcgtaggaaggttgtttggtttacgggttttattaccgtggggtactagtagtaccggtaaggtaacctacgtaaccggttaccggtccggttacgggggtaccggtttaccgggaaccgggtaaacggaaccggttaaagggacgaaacgtaaacccgtaaagttaccgttggttcggaactggaacctacgattccggtaacgttccgtttaacc

SEQ ID NO: 377645 - DNA, 628 bp, Homo sapiens
  misc_feature: GZ8MTXP01CT6TP.51.86.H09.1.454.CMB.2.raw
  modified_base (254)..(254): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagcccgcctccatctcctgcaggtctagtcaaggcctctatatagtgataggaaacnccttacttgtaattggtcagcagagccaggccaatctacaagacactaatttataagttcaacggctcgtcgggtcccagacagtatccgaggcggcaggtcggtacagggctatgtactttacacactagataagtcgacgagggtgaggctaggtaggtgttgggtttgggttttaatacgtgactaggtcgaacgtaacggttaaccacgtaaccgtcgggtccggttacgggggtaccgttaccgggaaccgtaaacggggaacccaaagggttaacggaaaacttacgaaaacggtaaacgtggttacgggttcttacggaacctaaacccgttcgttccgtacgttccttaaccgttaacgttccccg

SEQ ID NO: 377646 - DNA, 714 bp, Homo sapiens
  misc_feature: GZ8MTXP01CU0PC.51.86.H09.1.454.CMB.2.raw
tcagcgatcgtatacacgaccggtgctcgatttagtgctatagacttgggtttggggacccttgccttgactgatcaggactcctcagttcaccttctcacaatgagctccctgctcagctcctggggctgctaatgctcgtgggtcccaggttccaggtggggatgttgtgctgactcagtctccactcctccctgccccgtcacccgttggacagccgcctccatctcctgcagtctagtcaaggtcctctatatagtgatagaaacaccttattagtaagtttggttacagtcgagacgccagccaatcctaccgaaagtaccgtactttaaagtttacgttaacggtttacgtaaaccggtctccggtaccgggtacccagactagtacgttcgacgcggatagggtgggtaccagggactaacgtgtatttacactaacgtgaataacgtacggaaggtaggggtaggaggacgttagggtaaggttaggtttagggggtttttacgggtttttaaagtttaccgtagggtaacttaagtacgggtaaactaaacggggttaaccaccgtaacgggttccggaccgggttaacggggtaacccggttacgggtaaccgggaaacgggtaaaacccggtaaggggttaaaacgaaacgttaaacggaaaccgtaacgggtcggtcgggacttacgaaccgttaactaacg

SEQ ID NO: 377647 - DNA, 709 bp, Homo sapiens
  misc_feature: GZ8MTXP01BGXYL.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtcctccactcctccctgccccgtcacccttggacacgccgcctccatcctctgcaggtctagtcaaggtccctactatatagtgatacggaaacctactacttagaattggttacagcaggacggcctaggccaatcctacgaaacgtacctacctttaaatttaacgtaacggtttaccgtaaccgggtaccttcggtacccgggggtaccccaggacctagtacttcgaggtcggctaagggtgggtacagggctacgttgactttcaactacgtagaataacgtccgggaggtaagggggtgaagggtcgtagggtaggttagtttgggggttttacgggttttactaagtgtaccgtagtcggacgtaaacggtcctaaccggtacgtcggggtaccggttcggggtaacccggttaccggggaaccgttaaacgggggaaacccggtaagggttaacgggaaacttaaccggaaaacgtaaaccgttgggaacgggtcttaccggaaccgttaaccctttcgg

SEQ ID NO: 377648 - DNA, 818 bp, Homo sapiens
  misc_feature: GZ8MTXP01D9E9F.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctcgcccgtcacccgttggacagcccggcctccatcctcctgcaggtctagtcaacggcctctatatagtgatcgaaactacctattgaattggttacagacaggacggccaggaccaatcctaccaaagtaccgtaaccttaaagttttagttaaacggtttaccgtaaaccgggtactcgttacgggggtacccaaggacctaaggtacttcggaggtcccggacgtaacgggttggggtccgaacgggtcctaaaccgttggtaaccttttacccgaaacttaacccgttaggtaaacttaaacggttcccgggaaacgggtacggggggttacggggtaaacggggtcgttaagggtaaggggttaagtttacgggggttttttaaggggttttaactttaccgtaggggtaacgttaagtttacgggaacgtaaaacggggttaccaaccggtaacggttccgggtccggttaagggggtacccggtttaccgggaacccggggtaaaaggggaacccggttaaaggggtaaacggttaaaacgtaaccgtaaaaacgggttaaccgttggggttcgtaaccggttacaacccggtaaaccctaggttaccttccggtttaaccgtttcccg

SEQ ID NO: 377649 - DNA, 671 bp, Homo sapiens
  misc_feature: GZ8MTXP01E3R9V.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagcccggcctccatctcctgcaggtctagtcaacggcctctatatagtgataggaaacactacttagaattggttacagcagaggccaggaccaatcctacaaagtaccgtaccttaaatttacgttaacggtttaccctaaaccgggacttcgtacgggggtacccagaccagtactcgagcggcaaggtgggtccaggccacgttacgtatttacaactactagaataacgtcggacggaggggtgggaacggcgtagggaggtagttgggtttagggttttactacgtaggtacgtaagttcggaacgtaaagggtacaacgtacggtcgggtccggtaggggtaccggttccgggaaccggaaacggggtaaaccgttaaggggttaaacgaaaacgtaaccggtaaaacgttaaggttcgggttacggtctacggtccaacgtacgttcttcggtttccttaaccg

SEQ ID NO: 377650 - DNA, 756 bp, Homo sapiens
  misc_feature: GZ8MTXP01AO0RU.51.86.H09.1.454.CMB.2.raw
  modified_base (257)..(257): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgataggaaacnctattgaattggttcagcagaggccaggccaaatcctaccaaagtaccgtacctttaaaagtttaacgtaacggttttacctaaacccggggtacttcggtacgggggtaccccaaggaccagtacttacgaggaccgggctaaacgggttggggtcaaaggggtccaacgttggtaactttcaacctaacttaggaaacttaaacgtaccggaacggtaaggggggttagggaacgggtcgtagggtaagggttagtttacgggttttgggttttaaactttaccgttggggacctagttacggaacgtaaacgggttaccaaaccggtacggttcggggccccggttagggggtaacccggttacccggggaacccgtaaaagggggaaccccttaaagggggtaacggaaaaccttaacgtaaaaacgggaaccgttggttacggggaaccttcggaaccctaaaccgtacttaccttccggttccgtttaacccg

SEQ ID NO: 377651 - DNA, 664 bp, Homo sapiens
  misc_feature: GZ8MTXP01AVD85.51.86.H09.1.454.CMB.2.raw
  modified_base (214)..(214): a, c, t, g, unknown or other
  modified_base (260)..(260): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtcctccactcctccctgcccgtcaccctggacngccgcctccatctcctgcaggtctagtcaaggtcctactatatagngataggaaactctacttgaatttggttcagcaggacgccagccaatcctacaagacgtacctttaaagtttacgtaaaggtttcctaaaccggggaccttcggtacccgggggtacccaaggacctaagtacttacgagggccgggtcaaggggttcggggtacagggtacctagttgtaacgttttcaactacgtagattaaagtccgggagtagggggtcggaggtgtaggagggttatttggggggtttagggttttaactagtcggactagtgaacggtaaacggtcaccgtacgtcggggtccgtaaggggtaaccgttcggaaccgttaaaggggaacccaaagggttaagttaaaccttagaaaaccggtgtggtacggcttaggaaccgaaccttg

SEQ ID NO: 377652 - DNA, 537 bp, Homo sapiens
  misc_feature: GZ8MTXP01ECIY4.51.86.H09.1.454.CMB.2.raw
  modified_base (456)..(456): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggctccatctcctgcaggtctagtcaaggcctctatatagtgatggaaacactacttgaattggttcagcagaggccaggccaatctaccaagacgccttaaatttataaggtttctaaccggggactcgtcgggggtccccagacagattcagcggcaggtgggtcagggcactgatttcacactgataatcgacagggtgagctgagtatggttggtttatactgcatgcaaaggtcanacgtggccgtggggcgttcggaccgaaagggccaagggttcggaaattccgaaagaactgtagggcttggtcgaacctaag

SEQ ID NO: 377653 - DNA, 809 bp, Homo sapiens
  misc_feature: GZ8MTXP01EU1NP.51.86.H09.1.454.CMB.2.raw
  modified_base (198)..(198): a, c, t, g, unknown or other
  modified_base (244)..(244): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacngccggcctcatcctctgcaggtctagtcaaggcctactatatagtnataggaaactacctattagaattggtcagcagacgccaggccaaatctaccaaagtaccgtaccttaaagtttacgttaaacgggttttcgtaaaccccgggtcgtttcgtacggggggtaccccaaggtaccctaaggtactttaccccgaaggtccgggtacgagggttggggtaacccaggggtcctaaccgtgttaaccgtttcgaaacccttaacgtagggtaaactttaacgtacccgggaacgggtagggggttagggaaccgggttcggtaaaggggtttaagggttaaaggtttccggggttttttaaggggttttaactttaacgtggtaaccgtaggggttaacggtaaccggttaaaacggggacctaaaccggttccggtaccggggtaccggttacgggggtaacccgtttccggggaaccggtaaaacggggaacggtaaaccgggttaagggaaaacccctaagttaaaaccggttaccgtaagggttccgggttcacggttaaccaccctaaggttcttacgggttccttccggttaacgttcccccg

SEQ ID NO: 377654 - DNA, 743 bp, Homo sapiens
  misc_feature: GZ8MTXP01DJR87.51.86.H09.1.454.CMB.2.raw
  modified_base (249)..(249): a, c, t, g, unknown or other
  modified_base (367)..(367): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactcctccctgccccgtcacccgttggacagccgcctcatctcctgcaggtctagtcaaggccctctatatagtnatggaactactacttgaattggttcagcagacggccaggccaaatctaccaagacgtacttaaatttacgtaaggtttcctaacggctcgtacggggtccagacacgtatcgagcggntaagggtgggtccgaggtcctaacgtgtactttacactactagaactaacgtcggaacggtaggggttagggacggtgttagggtaagggttagtttaggggttttaggggttttaaacttacggtacgggtacgtaaacgttacgggtaaaccgtaaaacgggttacccaaccgttaccggtaccgggggttcccgttacggggggttacccgttaccgggggaccccggtaaaacgggggtaaccccgttaaagggggttaaacggaaaacgttacccggtaaaaacggttaaccgttggggttccggggtaacccttaccgggaacccgtaacccctaacggttcctttaacgggtttcccgttttaaccccg

SEQ ID NO: 377655 - DNA, 570 bp, Homo sapiens
  misc_feature: GZ8MTXP01BDMCP.51.86.H09.1.454.CMB.2.raw
  modified_base (353)..(353): a, c, t, g, unknown or other
  modified_base (379)..(379): a, c, t, g, unknown or other
  modified_base (403)..(403): a, c, t, g, unknown or other
  modified_base (539)..(539): a, c, t, g, unknown or other
  modified_base (548)..(548): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagcccggcctccatctcctgcaggtctagtcaaggcctctatatagtgataggaaactacctattgaattggtcagcagagccagccaatcacaaagacgacttaaatttataagtttcaaccgggctcgtgggtacccagacagattccagtcggnaggtgggtacaggcactgactttcanactgaataatcgagagggtggagngtaggaggtattggtttacgggtttatacgtgtactagtgacgtaaaggtacaagtcgttggaccgttaggggacgttccgggacgaaacgggaccgtaaagggagaaagtaccgaaaaggtaacgtgttacggcncgaacactntcgtcttacttcgaacgttccg

SEQ ID NO: 377656 - DNA, 687 bp, Homo sapiens
  misc_feature: GZ8MTXP01AIWZV.51.86.H09.1.454.CMB.2.raw
  modified_base (383)..(383): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtctccactcctccctcgcccgtcacccttggacacgccgcctcatctcctgcaggtctagtcaagcctactatatagtgataggaaactactacttgaattggttcagcaggcggccacggccaatccaccaagacctacttaaatttagtaacggtttacctaaccgggtctcggtccgggtacccagacagtatcagcgnaggtggtcgaggctactgtacttacgaactactaggtaataacgtaccggaggaggggtagggaggcgtagggtaggttaggtttagggggttttaggggttttaattaccggttagaccgtaagttcggtaaacgtaacgggtacctaaccggtacggttccggggacccgggtttaacggggtaacccgggttacggggaaccccggttaaagggggaaacccgtaaagggggttaaacgttaaacggttaaaccgtaaacggaaccggttggaccgggttcaccggccttaaccgtaacgg

SEQ ID NO: 377657 - DNA, 661 bp, Homo sapiens
  misc_feature: GZ8MTXP01A9CRH.51.86.H09.1.454.CMB.2.raw
  modified_base (390)..(390): a, c, t, g, unknown or other
  modified_base (402)..(402): a, c, t, g, unknown or other
  modified_base (501)..(501): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtgggatgttgtgctgactcagtctccactctccctcgcccgtcacccttggacacgccgcctcatctcctgcaggtctagtcaacggcctactatatagtgatacggaaactactacttgtaattgttcagcaggacggaccaggacaactctaccaaagaccgtacctttaaatttaagttaacggtttccgaaaccgggtcttacggttcgggtacccagactaggacttcgaggccggtanaagggtcgggtnaacggtcaacctgtacttcgaactactgtaatagttacgagggtagggtagggaggtcgttagggtagggtaattgggttttaagggtttaatttacgngggtactaggttcgaacgtaaagtaccgacgtacggtcgggtccggttagggtaccgttaccggaacccgggaaagggtaaccgaagggtacgaaacgttaacgaaaaccgttagttggttcggaatcggaacctacgacttcctaacgttcgtttaacc

SEQ ID NO: 377658 - DNA, 857 bp, Homo sapiens
  misc_feature: GZ8MTXP01BI00X.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctcgcccgtcacccgttggacacgccgcctccatcctctgcaggtctagtcaaggtcctctatatagtgataggaaactactactgaattgttcagcagagccaggccaatctaccaagaccgtacttaaatttaacgtaaggtttacccgtaaaccgggtcttaccggtcgggggttaccccaaagtaccgtaacgtactttacgaaggtccgggtaccgtaaggggtttaccggggtcgaaacggggtcccctaaacgtttacgggtaaacttttttcccgaaaacgttaaccgttacggtaaaattaaaacggttcccggggaaacgggtaacggggggttggggaaaccgggtacgtttacggggaaagggtttaaggtttagggggttttttaggggttttttaaacttaaccgtttcgggggaacgtttaggtacggtaaccgtaaaacggggttaccttaacccggaacggtttccgggggtacccgtttaacggggggtaaaccccggtttaccggggaaccccgggttaaaaaagggggaccccgttaaaacgggggttaaaggaaaaccgttaaccggaaaaaacggttacccgttgggttacggggtaacctcgggtaacccgtaaaccctagttccccgggtttaagtttcccgtttaaccccg

SEQ ID NO: 377659 - DNA, 581 bp, Homo sapiens
  misc_feature: GZ8MTXP01ASUZD.51.86.H09.1.454.CMB.2.raw
  modified_base (252)..(252): a, c, t, g, unknown or other
  modified_base (271)..(271): a, c, t, g, unknown or other
  modified_base (551)..(551): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctctgcagtctagtcaagtcctctatatagtgatggaaacnctatgaattgttcagcagngccaggaccaatctacaagacgtctaaatttagtaagtttccaaccgggtactcgtcgggtcccagacacgattcgaggcgcgaacgggttcgggtcaagggctacgtgtatttcactactgtataagtcgagtagggtgaggtctaggagtagttcggtttagggtttattacgtgcgtagtacgacgaaggtcacgtacgtcggtaccgtgggaacgttccgggaacgtaaacgggccgttaaggggaacgaaagtaacgaaacggacgttgggacgntagcctaccgattcgtaacgttcttaaccg

SEQ ID NO: 377660 - DNA, 646 bp, Homo sapiens
  misc_feature: GZ8MTXP01C0O0B.51.86.H09.1.454.CMB.2.raw
  modified_base (220)..(220): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccgttggacagcccggcctcactcctcngcaggtctagtcaacggcctctatatagtagatacgaaactcttattgtaattggttcagcagacgccagcaatctacaagactacttaatttacgtaacggtttcgtaaccggctacggtcgggtaccagacagtactcgaggcgcgaagggttgggtcgaggacctagttagtactttacatacgtagaataagtacggaggtaggggtggaacggtgtagggtaaggttagtttaggtttacgggtttttaataccggttgggtaactaggtacgaacgtaaacggtaccacgtacggtccggtacgtacggggtaccgttacgggaaccggaaacgggtaccgaaagggtaaacgaaactaaacggaacgttaacgttgggttaacgccgttagaacgacttattcttcgttaactttcccg

SEQ ID NO: 377661 - DNA, 624 bp, Homo sapiens
  misc_feature: GZ8MTXP01A7FX1.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaagcctctatatagtgatgaaactactattgaattggttcagcagaggccaggccaatcctacaaagtacgtacctttaaatttagtaacggtttacctaaaccggggacttccggtcggggtaccccagtaccaggtacttcgaggtcggactagggttacggggtcaaggggtcctaaacgttgtaactttcaactactaggtaataacgtcggaacgtagggggtggaagtcgtaggaggttagtttgggggtttagggttttattacgtgactagtgactaaacgggtcacgtacgtgggaccgttggggacgttcgggacgaagggaccgtaagggcgaaattaccggaaacgtagtggtacggacttggccttaactg

SEQ ID NO: 377662 - DNA, 631 bp, Homo sapiens
  misc_feature: GZ8MTXP01DK14E.51.86.H09.1.454.CMB.2.raw
  modified_base (220)..(220): a, c, t, g, unknown or other
  modified_base (276)..(276): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctcgggtcccaggttccagtggggatgttgtgctgactcagtctcccactcctccctcgcccgtcacccgttggacacgccgcctcatctcngcaggtctagtcaagtcctactatatagtagatgaaactcctatgtattgttcagnagagcagccaatcctacgaagacgtacttaatttagtaacggtttacctaacggctcgtcgggtacccagactacgacttcgaggccggcgtaaagggttcgggtcgagggacctacgttacgtactttacaactacttagtaattaacggacgaggaggggttaggagggtatagggaaggttagtttcgggtttagggttttacttacgttggacgtagtagacgtaaagtaccgacgacggtcggtacggtgggtaccgttaccggaccggaaagggacgaaagggtacgaaacgtacgaaacgttacgttggttagtcgacgaactacgtacgttctcgttaaccgttaac

SEQ ID NO: 377663 - DNA, 668 bp, Homo sapiens
  misc_feature: GZ8MTXP01AU785.51.86.H09.1.454.CMB.2.raw
  modified_base (367)..(367): a, c, t, g, unknown or other
  modified_base (434)..(434): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaactacctacttgaattggtcagcagaggccaggccaatcacaaagacgaccttaaatttagtaaacggtttcaaaccgggtattccgtagggggtcccagacagattcccagtcggntaggtcggggtacaagggcctagtgtaactttcgactactgtaaactaacgtcgaacggtagggggnggaggtagtaggtaggttagttgggttttaggtttatagtgactagggtacgtaacgtaaggtaccacgtacggtcggtacggtacgggaccggttaccggaaccgggaaacgggaaccggtaaagggtaaacggttaaacgtaaaccgttaaaacggtaacgtacggttacggttacttaccggaaccgtaaacctgtttccgtacgtttaccttaaccgttaaccgttcccg

SEQ ID NO: 377664 - DNA, 554 bp, Homo sapiens
  misc_feature: GZ8MTXP01BUTDX.51.86.H09.1.454.CMB.2.raw
  modified_base (290)..(290): a, c, t, g, unknown or other
  modified_base (382)..(382): a, c, t, g, unknown or other
  modified_base (462)..(462): a, c, t, g, unknown or other
  modified_base (534)..(534): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctctgcaggtctagtcaaggtcctctatatagtgataggaaacacctattgaattggttcagcagacgcagccaaatcncaagctactaaatttacgtaagtttcctaacggctcgtcgggtacccagacagattcgagcgcgaagtgggtcaggcactgactttcaactntagtactaagtcgacgagggtggaagcgtaggaggtattggtttgggttttatacgtgggactagttgacgaaaggtacncgacgttggccgtgggacgttccgggccgaaagggtacgaaggtaggaaatacgaaaagacgttgttacggntgctacacttcttcttcgtc

SEQ ID NO: 377665 - DNA, 642 bp, Homo sapiens
  misc_feature: GZ8MTXP01B8OIH.51.86.H09.1.454.CMB.2.raw
  modified_base (286)..(286): a, c, t, g, unknown or other
  modified_base (394)..(394): a, c, t, g, unknown or other
  modified_base (416)..(416): a, c, t, g, unknown or other
  modified_base (435)..(435): a, c, t, g, unknown or other
  modified_base (615)..(615): a, c, t, g, unknown or other
  modified_base (632)..(632): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacacggcccggcctccatcctccgtgcgtagtctacgtacgaacgtcctactatatagtagagtaacgaactacctagttagtagttcgtanacgagagacgcgacgacactctacagtacctacttaattacgttaagtaccgtacggtactcggtcggaccagactagtctacgacgcgcggtaggtcggaacgacgntacgtagtacttacgatcgtanatacgtggacggtaggggngtacggaggtaggtaggtttgttggggttttaccttacgtactggacttaggggtacggacgtaaaccgtctacggtccgttcgggacggtttacggggaccgtccgaagggaccggtaaacgaaggggtaacttaaaagtaacccgaaggttcgtcggttcgcggacctctaaccgttnttcgtattccttaaccncgtttccccc

SEQ ID NO: 377666 - DNA, 682 bp, Homo sapiens
  misc_feature: GZ8MTXP01EOJSV.51.86.H09.1.454.CMB.2.raw
  modified_base (626)..(626): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctcgcccgtcacccgttggacacgcccgcctccatctccgtgcgtagtctacgtacaacggtccttacctaatatagtgaatacggaaactacctacttgtaaatttggtacagtcaggacgaccaggccaaatcctaccaaagaccgtacttaaagttttagttaaacggtttaccgtaaccggtctttcggtcgggggtaccccaagacctagtacttccgacggtcggacgtaggtcgggtaacacgggtctactagtactttacagtactgtaaataacgtcggaacggtaggggagacggtatagggtagttaggtttggttttaggtttacttagtacgcgttaggtcgaacgttaaacggacgtaacgcggtacggcggttaacgggtcgtccggaacgtaaacgggtcggaaaaggtacgttaaactacggttaaaacgngttacgttggcttacggcctacggtaacttctcggttacttcttaacggttccccg

SEQ ID NO: 377667 - DNA, 576 bp, Homo sapiens
  misc_feature: GZ8MTXP01EGY0I.51.86.H09.1.454.CMB.2.raw
  modified_base (245)..(245): a, c, t, g, unknown or other
  modified_base (275)..(275): a, c, t, g, unknown or other
  modified_base (321)..(321): a, c, t, g, unknown or other
  modified_base (337)..(337): a, c, t, g, unknown or other
  modified_base (398)..(398): a, c, t, g, unknown or other
  modified_base (407)..(407): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactcctccctgcccgtcacccttggacagccggcctcatctctgcagtctagtcaaggcctctatatagtnatagaaactctattgaattggttcagcagngccagcaatctcaagacgtacttaattataacggtttcaaccggtntcgtgggtccagacanatgagcgcaagggtggtcaggtctagtgtacttcactatagatagcgagaggtaggacgtntaggaggtnttacggtttaggtttaactcgtaggtactagtagacgtaagtaccaacgtcgtacggcgtagggtaccgtcggaacgtaaacggggacttaagggaagttaaacgtaacgaaacggttagttcggttcggaacgtcgtaactaaccgtgttctaacggttcttaacccg

SEQ ID NO: 377668 - DNA, 706 bp, Homo sapiens
  misc_feature: GZ8MTXP01BJ5RY.51.86.H09.1.454.CMB.2.raw
  modified_base (202)..(202): a, c, t, g, unknown or other
  modified_base (682)..(682): a, c, t, g, unknown or other
  modified_base (693)..(693): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactcctccctgcccgtcacccttggacngccgcctcatcctctgcaggtctagtcaaggtcctactatatagtgatacggaaactctacttgaattggttcagcaggacgccaaggcccaaatcctaccaagaccgtacctttaaaagttttacgttaacgggtttacccgaaaccggggtaccttcggtacgggggtacccaaggtaccaagtacttcgagggccggtacgtaacgggttcggggtcaagggtcctaaaccgttggtaaaccttttcaacgtacgttagtaaagttaacgtacggaacgggtagggggtagggtaacggtcgttagggaaggggttagtttagggttttaggggttttaaattaccggttagggtacgtaagttacggacgtaaaggttaccgacgtacggtcgggtaccgtagggggtaccgttacgggacccggaaagggaaccgttagggtaacggttaaactacgaaacgttacgttgttcgntacgctacgtnttcgtgttccgtc

SEQ ID NO: 377669 - DNA, 594 bp, Homo sapiens
  misc_feature: GZ8MTXP01D35GD.51.86.H09.1.454.CMB.2.raw
  modified_base (243)..(243): a, c, t, g, unknown or other
  modified_base (294)..(294): a, c, t, g, unknown or other
  modified_base (381)..(381): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgccccgtcacccttggacagccggcctccatctcctgcaggtctagtcaagcctctatatagtnataggaaactactacttgaattggttcagcagagcagccaatctcaagacnctaatttataagtttctaacggactcgtgggtaccagacagatcagcgcagtggtacaggcactgatttcacactgataatcgacgngggtaggaggtcgtaggaggtattggtttagggtttatacgtagtactaggttacggacgtaaaggtacaccgtacgtcgggccgttaggggaccgttcgggaccgtaaacggggaaccctaaagggtaggaaaacgtacgaaaacggtacgttagttacgggttcttacggaacacccgtaattcgttacggttactttcgaactttccccg

SEQ ID NO: 377670 - DNA, 596 bp, Homo sapiens
  misc_feature: GZ8MTXP01EWQQN.51.86.H09.1.454.CMB.2.raw
  modified_base (293)..(293): a, c, t, g, unknown or other
  modified_base (330)..(330): a, c, t, g, unknown or other
  modified_base (336)..(336): a, c, t, g, unknown or other
  modified_base (448)..(448): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctcgcccgtcacccttggacacgcccggcctccatctcctgcaggtctagtcaaggcctctatatagtgatggaaacactactgaattggtcagcagagcagcaatctcaagnctaattagtagttctaacggctcgtcgggtccagacngtactnaggcgcaaggtgggtcaggcacttgtactttcgaactacgtgaaactaagtccgaaggtagggttaggaacggtgtaggtaaggttagttggttttagggttttaattacgnggtacgtagtacggactaaagggttaccagtaaccggtggtaccgtgggggtaccgtaccggacgggtaaacggaaccgttaaagggtacggttaaagtacgaaaacgttcgttagcggaatcgaaccactagttctgttccgttaac

SEQ ID NO: 377671 - DNA, 694 bp, Homo sapiens
  misc_feature: GZ8MTXP01A7F80.51.86.H09.1.454.CMB.2.raw
  modified_base (289)..(289): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactcctcccgtgccccgtcacccgttggaccacggcccggcctccatcctccgtgcaggtctagtcaaggtcctactatatagtgataggaaactacctattgaattggttcagnacggaggaccaggaccaatctaccgaaagtaccgtaccttaatttaagtaacggtttaccgtaaaccgggtctacggtacgggtacccagactacgtacttcgacggtcggacgtaagggtcgggtcgacgggtctaacgttgtaactttccgaaactactagtaataaagtcggaacggtagggggtaggtaggtacgttaggaaggttagtttagggtttagggttttaaacttacgtggtacgtagtgtacgtaaacgtacacgtaggtccggacggtcggggtaacggttccggaaaccggaaggggtaacccgttaaaggggtaacggaaacttaaaccgaaaacggttaacgttcggttacggaacgtagcccaacgtcttcgttcgttaacgttaacc

SEQ ID NO: 377672 - DNA, 571 bp, Homo sapiens
  misc_feature: GZ8MTXP01AIAS9.51.86.H09.1.454.CMB.2.raw
  modified_base (343)..(343): a, c, t, g, unknown or other
  modified_base (348)..(348): a, c, t, g, unknown or other
  modified_base (418)..(418): a, c, t, g, unknown or other
  modified_base (427)..(427): a, c, t, g, unknown or other
  modified_base (451)..(451): a, c, t, g, unknown or other
  modified_base (537)..(537): a, c, t, g, unknown or other
  modified_base (556)..(556): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaacggtccttactatatagtagataggaaacctccttattgaattggttcagcagacgcagacatctacaagactactaattagtaacgttcaacggctcgcgggtccagacacgntacgnggcgactagggttcggcgaggctatgtacttcacgtacagtataacggtcgacgtaggggtgacggtagnggaaggttnttgggttttaaggtttactaacgnggtacagtttcgaacgttaaacgctacgcgtggtaacccgtgggaaccttcgaacggaagtacgaaggtacgaaactacgaaacgngttcgcgctcggctaacgngttactcgttcttcc

SEQ ID NO: 377673 - DNA, 546 bp, Homo sapiens
  misc_feature: GZ8MTXP02ICULC.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggtttcagcagaggccaggccaatctccaagacgcctaaatttataaggtttctaaccgggatctggggtcccagacagatccagcggcaggtggtcagggcactgatttcacactgataaatcgacaggggtggaggctggaggatgttgggttttatactggctatgcaaggtacacacgtggcctggggacgtttcggaccgtaaaggggaccaaagggtagggaaaattacgaaaacgaaactgtcggactggaaccaccatctgtcttcacttcccg

SEQ ID NO: 377674 - DNA, 513 bp, Homo sapiens
  misc_feature: GZ8MTXP02HHHQ6.51.86.H09.1.454.CMB.2.raw
tcagcgatcgtatacacgaccggtgctcgatttagtgctatagacttgggtttggggatcaggactcctcagttcaccttctcacaatgaggctccctgctcagctcctggggctgctaatgctctggttcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcgcagtggtcaggcactgatttcacactgataatcgacagggtgaggctgaggatgttgggtttatactgcatgcaaggtacacactggcctgggacgttcggccgaagggaccaaggtggaaatcgaaaacgactagtcggactgcacatctgtctcattccc

SEQ ID NO: 377675 - DNA, 563 bp, Homo sapiens
  misc_feature: GZ8MTXP02I3TC4.51.86.H09.1.454.CMB.2.raw
tcagcgatcgtatacacgaccggtgctcgatttagtgctatagacttgggtttggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactcgtggggtccccagacagattccagcggcaggtgggtcaggcactgatttcacactgataaatcgacgaggggtggaggctgaggtattggtttgggtttattacgtgctagttgacgaaggttacacacgtgggcccgtgggggaaccgtttcgggaccgaaaggggacctaagggtaggaaaatcgaaaacgaacgtggtacggctagcaccatcctgtccttacactttcccg

SEQ ID NO: 377676 - DNA, 527 bp, Homo sapiens
  misc_feature: GZ8MTXP02GJJDM.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacgcctaatttataaggtttctaaaccgggactctggggtcccagacagattcagcgcagtgggtcaggcactgatttcactactgataaatcgacagggtgaggctgaggatgttgggtttattactgcatgacaaggtacacacgtggcctgggacgttcggacccgaaggggaccaaagggtaggaaaatcgaaaacgaactgtggcgtgacaccatcctgtctttc

SEQ ID NO: 377677 - DNA, 493 bp, Homo sapiens
  misc_feature: GZ8MTXP02IF0CH.51.86.H09.1.454.CMB.2.raw
  modified_base (252)..(252): a, c, t, g, unknown or other
  modified_base (420)..(420): a, c, t, g, unknown or other
  modified_base (434)..(434): a, c, t, g, unknown or other
  modified_base (462)..(462): a, c, t, g, unknown or other
  modified_base (474)..(474): a, c, t, g, unknown or other
  modified_base (476)..(476): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatgaacnctacttgaattggttcagcagaggccaggccaatctccaagacgcctaatttataaggtttctaaccgggactctggggtcccagacagattcagcggcagtggtcaggcactgatttcacactgataatcgacagggtgaggcgtgagagtgtggtttagttatgtnatgagagacacacngcgtggcgtcgacgacggacgagagaanacaacgacgagngngcgacacactctctctc

SEQ ID NO: 377678 - DNA, 558 bp, Homo sapiens
  misc_feature: GZ8MTXP02G9S7N.51.86.H09.1.454.CMB.2.raw
  modified_base (344)..(344): a, c, t, g, unknown or other
  modified_base (364)..(364): a, c, t, g, unknown or other
  modified_base (378)..(378): a, c, t, g, unknown or other
  modified_base (414)..(414): a, c, t, g, unknown or other
tcagcgatcgtatacacgaccggtgctcgatttagtgctatagacttgggtttggggatcaggactcctcagttcaccttctcacaatgaggctccctgctcagctcctggggctgctaatgctctgggtcccaggttccagtgggatgttgtgctgactcagtctccactctccctgcccgtcacccttggacagccgcctccatctcctgcaggtctagtcaaggcctctatatagtgatggaaacactactgaattgttcagcagagccaggccaatctccaagacgcctaaatttataaaggtttctaaccggactctgggtcccagacagatccagcgnagtggcaggcactgattcanactgataaatcganagggtggagcgtgagagtgttggtttagttatagtnatagagaagtaacgacacgtacggtaccgtacgggtacggtaccggtaccgaaacgggaaacggaaacggtaaaggaaacgtaaacgaaaacgaaacgtacgtacggtacgacgaacgaccaactactacgtcttactactccg

SEQ ID NO: 377679 - DNA, 548 bp, Homo sapiens
  misc_feature: GZ8MTXP02HK8WZ.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgacctaatttataaggtttctaaaccgggacttcgtcggggtcccaggacagattcagcggcaggtgggtcaggcactgatttcacactgataaatcgacgagggtgaggctaggaggagttgtttagggttttattacgtgctatgacgaaaggtacacgtacgtggccgtgggtacgttcggaccgtaacgggaccgaaaggtaggaaatacgaaacgaacgtgtggaactgacacatctgtctcg

SEQ ID NO: 377680 - DNA, 516 bp, Homo sapiens
  misc_feature: GZ8MTXP02HEPA4.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaatttataaggtttctaaaccgggactctggggtcccagacagattcagcggcagtgggtcagggcactgatttcacactgataatcgacagggtgagctgaggatgttggtttatactggctagtgacaaggtacacgacgtggctgggacgttcggaccgaagggaccagggtacgaaatacaaacgaactgtagctgcacatctgtctc

SEQ ID NO: 377681 - DNA, 533 bp, Homo sapiens
  misc_feature: GZ8MTXP02GF5BM.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaatttataaggtttctaaccggactctggggtcccagacagatcagcgcagtggtcaggcactgattcacactgataaatcgacagggtggaggctaggaggtattggtttggggtttattacgtgacagtgacaaggtacacactggccgtgggacgttcggacgaagggacaaggtaggaaatacgaaaacgaaacgtgtacgctgaacgaccatctgtcttcacttccc

SEQ ID NO: 377682 - DNA, 585 bp, Homo sapiens
  misc_feature: GZ8MTXP02JZCSY.51.86.H09.1.454.CMB.2.raw
tcagcgatcgtatacacgaccggtgctcgatttagtgctatagacttgggtttggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacacctacttagaattggttcagcagagccaggccaatctcaagaccgcctaattataaggtttcaaccgggactcgtcggggtcccagacagtattccagcgcaggtggtcaggcactgtattcacactgataatcgacgaggggtggaggctggaggtagtttggtttagggttttattacgtgcagtgacgtaaagggtacacgacgtcggccgtaggggtaccgttcgggaccgaaacggggaacccgtaaaggggtaggaaaactaccgaaaacggtaacgtggtacgggctacggaaccgaacctattcgtgttccttacactttccccg

SEQ ID NO: 377683 - DNA, 517 bp, Homo sapiens
  misc_feature: GZ8MTXP02JWWX3.51.86.H09.1.454.CMB.2.raw
  modified_base (256)..(256): a, c, t, g, unknown or other
  modified_base (391)..(391): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacncctacttgaattggttcagcagaggccaggccaatctccaagacgcctaaatttataaaggtttctaaaccgggactcgtggggtcccagacagattcagcgcagtgggtcaggcactgatttcacactgataancgacagggtgagctgagatgttggtttatactgtcatgcaaggtacacgacgtggcctggggacgttcggcgaacggaccgggaaagtggaaatacgaaacgactgacgcgtgcacatctgtcttc

SEQ ID NO: 377684 - DNA, 547 bp, Homo sapiens
  misc_feature: GZ8MTXP02IQZDX.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggccctctatatagtgatggaaacacctacttgaattggttcagcagaggccaggccaatctccaagacgcctaatttataaggtttctaaccgggactcgtggggtcccagacagattcagcgcagtgggtcaggcactgatttcacactgataatcgaacgaggggtgagctgaggtatgttgggttttatactgctatgacaaggtacacacgtggacctggggacgttcggaccgtaaaggggacccaaagggtcgggaaaaactcgaaaacggtaacgtggtacggctcgacaccatcttacgtctttacg

SEQ ID NO: 377685 - DNA, 652 bp, Homo sapiens
  misc_feature: GZ8MTXP02FWOH2.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaaatttataaggtttctaaccgggactcgtggggtcccagacagattcagcggcagtgggtcaggcactgatttcacactgaataatcgaacgagggtgaggctggaggtagttaggtttgggtttttaattacgtgtactagttacggacgtaaagggttaaccacgtaacgttcggggtaccgtacgggggtaaccgggtttccgggacccggtaaaacgggggaacccgtaaaaggggttacgggaaaaacgttaccgaaaaaccggtaaaccgttgggttaacggggccgttaacggacccgtaaacccgtagttaccgtttacggtttaccgttttaaacccg

SEQ ID NO: 377686 - DNA, 552 bp, Homo sapiens
  misc_feature: GZ8MTXP02IG1I7.51.86.H09.1.454.CMB.2.raw
  modified_base (437)..(437): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactactgaattggttcagcagaggccaggccaatctccaagacgcctaatttataaggtttctaaaccgggactcgtggggtcccagacagattcagcggcagtgggtcaggcactgactttcacactgaataatcgacgaggggtgaggctgaggattggttggtttattactgctagtganaaaggtacactacgtggtaccgtgggaccgttcggaccgtaaagggaccgaaagggtagaaaagtacgaaaacgaacgtgtacggaacgtacggacaaccgatccgttctactcg

SEQ ID NO: 377687 - DNA, 574 bp, Homo sapiens
  misc_feature: GZ8MTXP02IQCET.51.86.H09.1.454.CMB.2.raw
  modified_base (388)..(388): a, c, t, g, unknown or other
  modified_base (425)..(425): a, c, t, g, unknown or other
tcagcgatcgtatacacgaccggtgctcgatttagtgctatagacttgggtttggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctaccaagacgcctaaatttataaggtttcaaccgggctcgtgggtcccagacagattccagcgcagtggtcaggcactgatttcacactgataaatcganagggtgagctgaggatgttgggtttatactgcatganaaggtacacgactggccgttggggacgtttcggaccgaaaaggggacccgaaaagggtagggaaaattaccgaaaaacggtaaacgttggtagggacttcggaaccgaaacccgtaagttaccctagtttccctttaccaatttccccg

SEQ ID NO: 377688 - DNA, 554 bp, Homo sapiens
  misc_feature: GZ8MTXP02HOUGU.51.86.H09.1.454.CMB.2.raw
  modified_base (255)..(255): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacncctacttgaattggttcagcagaggccaggccaatctccaagacgcctaaatttataaggtttctaaaccgggactctggggtcccagacagattcagcggcagtgggtcaggcactgatttcacactgataatgacagggtgagctgaggatgttgggttttattactgtctatagtagaagtacgacaactggtcgtacggtacggttacggaccgaacggaaccggaaacggtacggaaagttaacgaaacgaaaccgtaagtaggcgtggacgacaactactacgttactttccg

SEQ ID NO: 377689 - DNA, 543 bp, Homo sapiens
  misc_feature: GZ8MTXP02JYI2R.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaatttataaggtttctaaaccggctctggggtcccagacagattcagcgcagtgggtcagggcactgatttcacactgataatcgacaggggtgaggctgaggatgttgggtttattactggcagtgcgaaggtacacgactggccctggggtacgttcggacccgtaaaggggacccaaagggtggaaaagtcgaaaacgaacgtgtagggctggacaccgtatccgtcgtctttccg

SEQ ID NO: 377690 - DNA, 531 bp, Homo sapiens
  misc_feature: GZ8MTXP02JD4DD.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaatttataaggtttctaaccgggactcgtggggtcccagacagattcagcggcagtgggtcaggcactgatttcacactgataaatcgaacgagggtggagctaggaggatgttgggttttatactgctagtgacaaggtacacacgtggcctgggacgttcggaccgaaggggaccaaggtacggaaatacgaaacgaactgtaggcgtgacaccatctgtcttac

SEQ ID NO: 377691 - DNA, 542 bp, Homo sapiens
  misc_feature: GZ8MTXP02GK9ZT.51.86.H09.1.454.CMB.2.raw
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgattcacactgataatcgacagggtgaggctgaggattggttgggttttattacgtgctatgacgaaaggtacacgatcggccgtgggacgttcggaccgtaaggggacccgaaggtacggaaaatacgaaaacgaactaggaggcgtaggaccacgatcgtcgttcttac

SEQ ID NO: 377692 - DNA, 572 bp, Homo sapiens
  misc_feature: GZ8MTXP02HWUPJ.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatgaaacacctacttgaattggttcagcagaggccaggccaaatctaccaaagacgacctaaatttataaggtttcaaaccgggctcgtcggggtcccagacagattcagcgcaggtgggtcagggcacgtgatttccactactgaataatcgacgagggtggaggctagaggtattggttagggtttatactgcatgacgaaggtacacacgtggccgtagggacgttcggaccgaaagggaccgtaagggtaggaaaactcgaaaacgtaaccgttggacggtctaggaacctaaccgaacttcgtacgtcctttctaacttccccg

SEQ ID NO: 377693 - DNA, 643 bp, Homo sapiens
  misc_feature: GZ8MTXP02IBNS3.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaactactactgtaattggttcagcagagccagccaatctacaagacgtacctaatttataacggtttctaaaccgggtctcgtcggggtacccagacagattcgagcggcaggtcgggtcagggcaccgtgtaactttcaaactacgtagtaataaacgttcggaacggtagggggtgggaagggcgttaggaagggtagtttgggttttaggggtttatttacgtggtatagtgtacgtaaaggtacaacgtacgtggtaccgtagggtaccgttcgggaaccggtaacgggaaaccgtaagggtaagtaaaacgttaaccgaaaaccggtacgttacgtacgggaaccgttcggaccgaccgtaacttcccgttagtttacctttacccg

SEQ ID NO: 377694 - DNA, 530 bp, Homo sapiens
  misc_feature: GZ8MTXP02IYYB1.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaaatttataaggtttctaaccgggactctggggtcccagacagattccagcgcagtggtcaggcactgatttcacactgataatcgacaggggtggaggctgaggtatggtttgggtttatactgctagtgacaaggtacacacgtggccgtgggacgttcggacgaagggaccaagggtaggaaaatcaaaacgacgtgtacgctgcaccatctgtcttcacttccc

SEQ ID NO: 377695 - DNA, 557 bp, Homo sapiens
  misc_feature: GZ8MTXP02HMU0V.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggccctctatatagtgatggaaacacctacttgaattggttcagcagaggccaggccaatctccaagacgcctaaatttataaggtttctaaaccgggctctggggtcccagacagatcagcggcagtgggtcagggcactgatttcactactgataatcgacgagggtggaggctgaggattgttgggtttatacgtgctagttgacgaaaggtacacgtacgtgggccgtaggggtacgttcggaccgaaacggggacccgaaaggggtacggaaaactacgaaaacgacgttagcggaacgtgacacctatccgtgttacttc

SEQ ID NO: 377696 - DNA, 527 bp, Homo sapiens
  misc_feature: GZ8MTXP02FGRUM.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaaatttataaaggtttctaaaccgggactctggggtccagacagattcagcggcagtgggtcagggcactgatttcacactgataaatcgacagggtgagctgaggatgttgggtttatactgcatgacaaggtacacactggcctgggacgttcggcgaagggaccaaagggtaggaaaatcgaaaacgaactgtaggcctggacaccgatctcgtctttac

SEQ ID NO: 377697 - DNA, 556 bp, Homo sapiens
  misc_feature: GZ8MTXP02I952W.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctatgaattggttcagcagaggccaggccaatctacaagacgacctaatttataaggtttcaaccgggactcgtgggtcccagacagattcagcggcaggtgggtcaggcactgattcacactagataatcgacgaggggtgagctaggagtattggtttacgggttttatacgtgactagtgacgaaggtacactacgtggacgtgggacgtcggacgaaacggggaccaaagggtacggaaaataccgaaaacgaacgtggtacggcgtacgaccgtacctatcctacgtctttaccg

SEQ ID NO: 377698 - DNA, 519 bp, Homo sapiens
  misc_feature: GZ8MTXP02F24ZT.51.86.H09.1.454.CMB.2.raw
tcagcgatcgtatacacgaccggtgctcgatttagtgctatagacttgggtttggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaatttataaggtttctaaaccgggactctggggtcccagacagattccagcggcagtgggtcaggcactgatttcacactgataaatcgacagggtgaggctgaggatgttgggtttatactgcatgcaaggtacacactggcctggggacgttcggccgaagggaccgaaggtaggaaatacaaacgaactgtggctgcaccactctgtcttcatccg

SEQ ID NO: 377699 - DNA, 585 bp, Homo sapiens
  misc_feature: GZ8MTXP02G76G8.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaaagaccgacctaatttagtaaggtttctaaccgggactcgtgggtcccagacagatcagcggcagtgggtcaggcactgattcacactgaataatcgacgagggtggagtctaggaggtattggtttagggttttatacgtagactagacgtaagtaacgacacgtacgtcggtacggtagggttaccggacggaacggaacggaacggtaaaggaacggtaaacaaaccgaaacggtacgttggacgtacgtacgaacctaacgtcttacgttctacctactcgtttccccg

SEQ ID NO: 377700 - DNA, 537 bp, Homo sapiens
  misc_feature: GZ8MTXP02JUMZR.51.86.H09.1.454.CMB.2.raw
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacgcctaaatttataaggtttctaaccgggactcgtggggtcccagacagattcagcggcagtgggtcagggcactgatttcactctgataatcgacaggggtgagctgaggattgttgggttttatacgtgcagtgacaaggtacacgactggcctggggacgttcggaccgtaaggggaccaaagggtaggaaactacgaaaacgacgtgtaggcgtacgcaccgtatctcgtcttacg

SEQ ID NO: 377701 - DNA, 563 bp, Homo sapiens
  misc_feature: GZ8MTXP02IV92C.51.86.H09.1.454.CMB.2.raw
  modified_base (255)..(255): a, c, t, g, unknown or other
  modified_base (327)..(327): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctattgaattgttcagcagagccaggccaatctaccaagacgacctaaatttataaggtttcaaaccgggntcgtggggtcccagacagatcagcgcagtgggcaggcactgatttcacactgataatcgacgagggtggagctagaggtattggtttagggttttactacgttgataagttgacgaaaggtacacgtaacgtggaccgtggggtaaccgttcggaccgaaagggaccgtaaagggtaggaaaactacgaaaacgtaacgtggtacggaactcgacaaccgtatacgtacgtctacg

SEQ ID NO: 377702 - DNA, 549 bp, Homo sapiens
  misc_feature: GZ8MTXP02FUM1W.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacgcctaaatttataaggtttcaaccggactcgtggggtcccagacagattcagcgcagtgggtcagggcactgatttcacactgataaatcgacgaggggtggaggcgtaggaggtattggtttagggtttattactgcatgacaaggtacacacgtggcgtgggacgttcggaccgaagggaaccgaaggtaggaaactacgaaaacggaactgtacggctacgaacgaccatactcgtacttcactttcccg

SEQ ID NO: 377703 - DNA, 541 bp, Homo sapiens
  misc_feature: GZ8MTXP02IT99U.51.86.H09.1.454.CMB.2.raw
  modified_base (297)..(297): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacncctaatttataaggtttctaaccgggactcgtggggtcccagacagattccagcgcagtggcagggcactgatttcacactgataaatcgacgaggggtggaggctggaggattggtttagggttttattacgtgactagtgacaaggtacacacgtggccgtagggacgttcggaccgaaagggaccaaagggtaggaaatcgaaaacgactgtacgctgcacagtctagtcttacattcccg

SEQ ID NO: 377704 - DNA, 650 bp, Homo sapiens
  misc_feature: GZ8MTXP02HMUWZ.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctacttgaattggttcagcagaggccaggccaatctcaagacgcctaattataaggtttctaaaccgggatcgtggggtcccagacagattcagcggcagtgggtcaggcactgaatttcactactagaattaaagcgaacgagggggttggaggtcgtaggtaggtagttaggtttagggttttaagtttacgttagtcgtaagttggacgtaaggttaacgaacgaacgtacggtaccggtcggggtaccggtttaccgggtaccggtaaacgggtaaacccggaaacgggttaaacgggaaaaggttaaacgtaaaaccggaaaaccgttaacggttagggtaaccggtaggaccgtaaccgaacgttacttacggtttacgttttacccg

SEQ ID NO: 377705 - DNA, 560 bp, Homo sapiens
  misc_feature: GZ8MTXP02H7IDF.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctattgaatttggttcagcagaggccaggccaatctacaagacgccttaaatttataaaggtttctaaccgggactcgtcggggtcccagacagattcagcggcaggtggggtcagggcactgatttcacactgataatcgacgagggtggaggctgaggtagttggtttagggttttattacgtgctagtgacaaggtacacacgtggccgtaggggtacgttcggacgaaacggggaaccgaagggtaggaaatacgaaaacgaacgtagtacggactcggacacctag

SEQ ID NO: 377706 - DNA, 538 bp, Homo sapiens
  misc_feature: GZ8MTXP02I44EY.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctaccaagaccgcctaatttataaggtttctaaccgggactctggggtcccagacagattcagcggcagtgggtcaggcatgatttcacactgataatcgacgagggtgagcgtgaggatgttggttttattacgtgctatgcaaggtacacgacgtggaccgtgggacgttcggaccgaaacggggaccaaagggtcggaaaatacgaaaacgaactggtagaacgtcgacaccatctcgtacttc

SEQ ID NO: 377707 - DNA, 596 bp, Homo sapiens
  misc_feature: GZ8MTXP02GBOEL.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaaatctcaaagacgccttaaatttataaaggtttctaaaccgggacttcgtggggtccagacagattcagcggcagtgggtcaggcactgatttcacactgaataatcgagagggtgagctgaggtatcggtttagggtttattacgtggtactagtagtacgaaaggtaccacgtacgtgggaccctggggaccgtttcggacccgaaaaggggaccgtaaagggttacggaaaattaccgaaaaacggtaaaccgtggttaacgggcttacggaccaaaccgtattccgttaagttcttttaaccg

SEQ ID NO: 377708 - DNA, 578 bp, Homo sapiens
  misc_feature: GZ8MTXP02GMGJX.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctcctatatagtgatggaaacacctacttgaattggttcagcagaggccaggccaatctccaaagacgacctaaattttataaaggtttcctaaaccggggacttcgtggggtcccaggacagattcagcggcagtgggtcaggcactgatttcacactagaataatcgacaggggtgagctaggaggtattaggttgggttttaattacgtgctagtgacgaaaggtaacacgacgttcggccgttgggacgttcggaccgaaacggggtaacccgaaagggttagaaaagttaccaaaacggtaaacctggtaggaactaggacctacactactagtcttacg

SEQ ID NO: 377709 - DNA, 603 bp, Homo sapiens
  misc_feature: GZ8MTXP02JY9SS.51.86.H09.1.454.CMB.2.raw
  modified_base (255)..(255): a, c, t, g, unknown or other
  modified_base (358)..(358): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctacttgaattggttcagcagaggccaggccaatctaccaagacgccttaaatttataacggtttctaaccgggactcgtggggtcccagacagatcagcgnagtgggcaggcactgatttcactactgataatcgacgagggtgaggctggaggtattggtttagggttttattcgtgcgtagtgacgtaaaggtaccacgtacgtcggtccgtagggggtaccgttcgggacccgtaaacggggaacccgtaaagggtacggggtaaaactaccgaaaacggtaaccgttggtacgggaaccttacggaccctaccgtacgttcctttacggttacctttacccg

SEQ ID NO: 377710 - DNA, 568 bp, Homo sapiens
  misc_feature: GZ8MTXP02ISHYR.51.86.H09.1.454.CMB.2.raw
  modified_base (340)..(340): a, c, t, g, unknown or other
  modified_base (382)..(382): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaattctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagacggccaggccaatctccaagacgcctaatttataaggtttctaaccgggactcgtggggtcccngacagattcagcggcaggtcgggtcaggcacgtgatttacanactgaataatcgacgagggtgaggctgaggattggttgggttttatactgctatgctaaggtacacgtaacgtcgggccgtacggggtacgttcgggaccgaaaggggtaacccgaagggtagggaaaactacgaaaacgtacgtaggtcggctcgacaaccagtctcgtcttcactccgtacccg

SEQ ID NO: 377711 - DNA, 571 bp, Homo sapiens
  misc_feature: GZ8MTXP02FYX2Z.51.86.H09.1.454.CMB.2.raw
  modified_base (309)..(309): a, c, t, g, unknown or other
tcagcgatcgtatacacgaccggtgctcgatttagtgctatagacttgggttttgggggtacccgttcgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggccctctatatagtgatggaaacacctacttgaattggtttcagcagagccagccaatcncaagacgactaatttataaggttctaacgggactcgtcggggtacccagacagattcagcggcagtggggtcaggcactgatttcacactagataatcgagaggggtggaggctgaggagttggtttacggggtttttatacgtggtacagtggactaagggtacacgaagtcggccgtcggggacgttcgggaccgaaaggggtaaccgaagggtaacgaaacgtacgaaaacgtacgtggtacgaccgtggacacctaag

SEQ ID NO: 377712 - DNA, 562 bp, Homo sapiens
  misc_feature: GZ8MTXP02JXYNB.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatgaaacacctacttgaattggtttcagcagaggccaggccaatctccaagacgcctaatttataaggtttcaaccgggctcgtggggtcccagacagattccgagcggcaggtgggtcagggcactgtactttcgacactgataatcgaacaggggtggaggcgtggaggtattggtttgggtttatacgtgctagtgacaaggtacacacgtggaccgtggggaccgttcggaccgaaaggggaccaaggggtagaaactacgaaaacgacgtggacggctaggaacctacgattccgtagtccttacacttcccg

SEQ ID NO: 377713 - DNA, 664 bp, Homo sapiens
  misc_feature: GZ8MTXP02IAPB3.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtctccactctccctgcccgtcacccttggacagccggcctccatctcctgcaggtctagtcaaggcctctatatagtgataggaaacacctacttagaatttggttacagcaggacggccaggaccaaatcctaccaaaggtaccgtacctttaaaattttaagtaaacgggtttacctaaaccggggtacttcggtaccggggtaccccaaggaccagtatttccgaggccggacgtaagggtcggggtaccagggccacttgtactttacaactacgtagtaaataagtaccggaaggtagggggtaggaacggtcgtaggaaagggttgtttagggttttaggggtttttaattacgttggactagttggactaaaggtacacgtacgtggaccggttgggtaccgttcgggaaccgaaaggggaccgtaaagggtacggaaaactcgaaaaccgagtaggtcggactcgactaacgtcg

SEQ ID NO: 377714 - DNA, 565 bp, Homo sapiens
  misc_feature: GZ8MTXP02H0C14.51.86.H09.1.454.CMB.2.raw
  modified_base (277)..(277): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatcctcctgcaggtctagtcaaggcctctatatagtgatggaaacacctatgaattggttcagcagngcaggccaatctaccaagacgtacctaaatttagtaaggtttcctaaaccggtactcgtggggtaccccaggacagattcagcggcaggtgggtcaggcacgtgatttcaactactagataacgtcgacgagggtggagcgtaggaggtagttggttagggttttaattcgtgactagtgacgtaaggtacacgtacgtggaccgttgggacgttcggaccgaaacgggaccgtaaaggtagaaaactacgaaacgaacgtgtagcgtacgacacctatctcgtactc

SEQ ID NO: 377715 - DNA, 559 bp, Homo sapiens
  misc_feature: GZ8MTXP02GX8KE.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaaagaccgacctaaatttataaaggtttctaaaccgggacttcgtggggtcccagacagtattcagcgcagtgggtcaggcactgatttcactactagataatcgacgagggtgagctagaggtattggttagggtttatacgtgctagtgacaaggtacacgacgtggaccgtgggaccggtacgacgtaaacgggaccgaaagggtacgaaactacgaaaacgtaacgtggtaggaactggaccacctatcgtgtacttacg

SEQ ID NO: 377716 - DNA, 567 bp, Homo sapiens
  misc_feature: GZ8MTXP02F26R7.51.86.H09.1.454.CMB.2.raw
  modified_base (555)..(555): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgacctaatttataaggtttctaaccgggactcgtggggtcccagacagattcagcgcagtgggtcaggcactgatttcactactgataatcgacgagggtgaggctggaggtagttggtttgggttttattacgtggactagttgacgtaaaggtaccacgtacgtgggccgtggggtacgttcggccgaaaacggggaccaaagggtacggaaaactacgaaaacgtaactggtacggctaggacctaaccgtntcgtcgtactcg

SEQ ID NO: 377717 - DNA, 544 bp, Homo sapiens
  misc_feature: GZ8MTXP02HZ0W1.51.86.H09.1.454.CMB.2.raw
  modified_base (255)..(255): a, c, t, g, unknown or other
  modified_base (300)..(300): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctacttgaattggttcagcagaggccaggccaatctcaaagacncctaatttataaggtttctaaccggactctggggtccccagacagattcagcgcagtgggtcaggcactgattcacactgataaatgacagggtgagctgaaggtatggttagggtttaatttacgtgtactagtgacgtaaaggtacacgacgttggccgttaggggaacgttcggaccgaaaggggaccaaagggtacgaaaagtacaaaacgaactggtagcgtgcaccatctcgtacttc

SEQ ID NO: 377718 - DNA, 759 bp, Homo sapiens
  misc_feature: GZ8MTXP02GJHE8.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggcccaaatctaccaaagacgaccttaaattttagtaaacggttttcctaaaccggggacttcgtacggggtccccaaggaccaggtaacttccaaggtccgggactaaggttggggtccgaaaggggtccaaacgttggtaactttttccaaacctaacgtttaggaaactttaaaacgtcccgggaaacgtaaggggggttaggggaaacggggccgtttaagggaaggggttaaacgtttgggttttagggggttttttaaactttaaccgttgggtacctagttacggaacgtaaaacgggttaaccacgtaacgtcggggtacccgttacgggggtaaaccggtttccgggaaccggtaaaacggggaacccggtaaaacggggttaggaaaaacgttaccgaaaaacggtaaacctgggttacgggaacttacggaccaaccgtaacgttaccttcgttactttacccg

SEQ ID NO: 377719 - DNA, 548 bp, Homo sapiens
  misc_feature: GZ8MTXP02GGQC5.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctgggcctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagagcaggccaatctacaagacgcctaattataaggtttctaaccggatcgtgggtcccagacagatcagcgcagtggtcaggcactgattcacactgataatcgacagggtgaggctgagattgttgggtttatactgcagtgagaaggtacacacgtggaccgtgggtacgttcggaccgaaagggaccgaaaagggttaggaaaacttacgaaaacggaaacgtgtacgggacctaggaaccaccaattctacgtcctttactaactttcccg

SEQ ID NO: 377720 - DNA, 508 bp, Homo sapiens
  misc_feature: GZ8MTXP02JN7II.51.86.H09.1.454.CMB.2.raw
  modified_base (401)..(401): a, c, t, g, unknown or other
  modified_base (422)..(422): a, c, t, g, unknown or other
  modified_base (433)..(433): a, c, t, g, unknown or other
  modified_base (436)..(436): a, c, t, g, unknown or other
  modified_base (488)..(488): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagagccaggccaatctccaagacgcctaatttataaggtttctaaccgggactcgtggggtcccagacagattcagcggcagtggtcaggcactgatttcactactgataatcgacagggtgagcngagatgttggtttatactgcntgcgaagtcanacngctggacgtcgcgaacggaccaaggtggaaactacgaaacgaactgtaggcncgacacatctcgtactttcc

SEQ ID NO: 377721 - DNA, 596 bp, Homo sapiens
  misc_feature: GZ8MTXP02I6XDG.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctactgaattggttcagcagaggccaggccaatctccaagacgcctaaatttataaggtttctaaaccgggactcgtggggtcccagacagattcagcggcaggtgggtcagggcactgatttcactactgataatcgaacgaggggtggaggctggaggagttgttggggttttattacgtggactagtcgacgtaaaggtacacgtacgtcgggacccgttagggggtaccgttccggggaccgaaaacgggggaacccgaaaggggttaggaaaacgtaccgaaaacgtaacgtggtacgggctacggactacccgattccgtacgttcctttacc

SEQ ID NO: 377722 - DNA, 609 bp, Homo sapiens
  misc_feature: GZ8MTXP02HGBJD.51.86.H09.1.454.CMB.2.raw
  modified_base (254)..(254): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatggaaacncctatgaattggttcagcagaggccaggccaatctacaagacgactaatttataacggtttctaaccggactcgtcgggtacccagacagatcgagcggcaggtgggtcaggctacgtgtactttcaactactagaataagtcgagagggtgaggcgtaggaggtagttgggtttagggttttattacgtgtacgtagtaggtaccgaaaggtaaccacgtacgtcgggtcccgttaggggaccggttacggaaccggtaaaacgggaacccgtaaaggggtacgaaaacgttaacgaaaaccggtaacgtggtacgggctacggacctaccgtagtcctacgtttccttaaccg

SEQ ID NO: 377723 - DNA, 595 bp, Homo sapiens
  misc_feature: GZ8MTXP02I796O.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctaccaagacgaccttaaatttataacggtttcctaaccgggacttcgtggggtcccagacagattcagcgcaggtgggtcaggcactgtatttcactactgataaatcgaacgaggggtggaggctaggaggtattggtttagggttttattacgtgctagttgacgtaaacggtaccacgtacgtgggtacccgtggggtaaccggtttcgggaccgtaaaacggggaccgtaaagggtacggtaaaactacgaaaacgtaacgtggtacggcgtcggacaccctattccgtcgtactttac

SEQ ID NO: 377724 - DNA, 596 bp, Homo sapiens
  misc_feature: GZ8MTXP02IR4UV.51.86.H09.1.454.CMB.2.raw
  modified_base (255)..(255): a, c, t, g, unknown or other
  modified_base (277)..(277): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggccctctatatagtgatggaaacncctattgaattggttcagcagnggccaggccaatctaccaagacgtcctaaatttataaggtttcaaccgggctcgtggggtccccagacagtatcgagcggcaggtgggtcaggccacgtgtactttcactactgataatcgacgaggggtgagcgtagaggtagttgttggttttattactggctagttgacgaaaggtcacgacgtgggacccgttggggtaccgtttcgggacccgtaaaaggggtacccgaaagggtacgggtaaaactaccgtaaaacggaacttggttacggaaccgttcggacccaaccctagttcttacggttacctttccg

SEQ ID NO: 377725 - DNA, 553 bp, Homo sapiens
  misc_feature: GZ8MTXP02GPJC2.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaaatttataaggtttctaaccgggactctggggtccagacagattcagcggcagtgggtcagggcactgatttcacactgataatcgaacgagggtggaggctggaggtatggttagggttttattacgtgcattgacaaaggtacacacgttggcctggggacgttcggaccgaaaggggaccgaaagggtaggaaaagtacgaaaacgtaactaggtacggcgttcgaccaccgatctcgtctttac

SEQ ID NO: 377726 - DNA, 611 bp, Homo sapiens
  misc_feature: GZ8MTXP02IHHID.51.86.H09.1.454.CMB.2.raw
  modified_base (268)..(268): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggccctctatatagtgatggaaacncctacttgaattggttcagcagaggccaggccaaatcctacaaagacgtaccttaaattttataaaggtttccaaaccggggtactcgtcggggtaccccagacagtacttcgagcgggcaggtggggtaccagggctactgtatttcactactgaataatcgacgagggtggaggcgtgaggtattggtttagggtttttattacgttgactagtgacgaaggtacacgtagtcggtccgtacggggtacggttaccggaccggtaaaacggggaaccgtaaagggtaacggaaaactaacgaaaacggtaacgtaggtacggacttcggactaaccgtacg

SEQ ID NO: 377727 - DNA, 578 bp, Homo sapiens
  misc_feature: GZ8MTXP02H2Y1M.51.86.H09.1.454.CMB.2.raw
  modified_base (255)..(255): a, c, t, g, unknown or other
  modified_base (287)..(287): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctattgaattggttcagcagagcagcaatcncaagacgctaatttataagtttcaacgggtactcgtggggtcccagacagattcagcgcaggtgggtcagggcactgattcactactgataatcgacgaggggtgaggctaggaggtagtttggtttaggggtttattacgtgactagtgacaaggtacaacgacgtggccgttaggggacggttccggaaccggaaacgggaaccggtaagggtaacggaaaacgtaacgaaaaccggtaacgtggtacggaacgttcggaccaaccgtattcgttacgttcctttaacc

SEQ ID NO: 377728 - DNA, 580 bp, Homo sapiens
  misc_feature: GZ8MTXP02JWEG2.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctaccaaagacgtcctaatttataaggtttctaaccgggactcgtggggtcccagacagatccagcgcagtgggtcagggcactgatttcacactgataatcgacaggggtggaggctgaggtatggtttagggtttataacgtgctaagttgacgtaagggtacaactacgtgggcccgtagggggaccgttcgggaccgaaaggggacccgaaaggggtaggaaaactacgaaaacggtaactggtacggacctaggaaccgtaccgatcgtcgtacttcgactttccccg

SEQ ID NO: 377729 - DNA, 514 bp, Homo sapiens
  misc_feature: GZ8MTXP02H3TP9.51.86.H09.1.454.CMB.2.raw
  modified_base (188)..(188): a, c, t, g, unknown or other
  modified_base (375)..(375): a, c, t, g, unknown or other
  modified_base (438)..(438): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtnacccttggacagccggcctccatctcctgcaggtctagtcaaggcctctatatagtgatggaaacactacttgaattggttcagcagagccaggccaatctccaagacgcctaatttataaggtttctaaccgggactctggggtcccagacagattcagcggcagtgggtcaggcactgatttcanactgataatgacagggtgaggctgaggtatgttggtttattactgctatgacaaggtaccaanacgtggcgtgggacgtcgacgaacggacgaaggtacgaaatacgaaacgactgtagcgtcgacacatctcgtactc

SEQ ID NO: 377730 - DNA, 553 bp, Homo sapiens
  misc_feature: GZ8MTXP02JQEPO.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctaccaagacgaccttaatttagtaaggtttctaaccgggactcgtggggtcccagacagattcagcgcagtggtcaggcactgattcactactgataatcgacgagggtgagcgtaggaggtagttggtttagggttttattacgtgtctagtgacgtaaggtacacgtacgtcggcgtgggtacgttcggaccgaacgggaccgaagggtacggaaactacgaaaacgacgtggtaggcgtgacacgatctcgtacttacg

SEQ ID NO: 377731 - DNA, 562 bp, Homo sapiens
  misc_feature: GZ8MTXP02GESCI.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgccttaaatttataaggtttctaaaccgggactcgtggggtcccagacagattcagcggcaggtgggtcaggcactgatttcacactgataatcgagaggggtgaggctgaggtattggtttgggtttattacgtggctagtgacgaaggtaccacgacgtggccgtaggggacgttcgggaccgtaaaggggaccgaaagggtacggaaaactacgaaaacgaacgtggtacggcgtacgacaccatcgtcgtactttccg

SEQ ID NO: 377732 - DNA, 609 bp, Homo sapiens
  misc_feature: GZ8MTXP02I6KXS.51.86.H09.1.454.CMB.2.raw
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacacgccggcctccatctcctgcaggtctagtcaaggcctctatatagtgataggaaacacctatgtaattggttcagcaggacggccaggccaatctaccaaagacgtaccttaaatttaagtaacggtttaccgtaaaccgggcttcggtacggggtacccagaacctagacttacgaggcggactaggtcgggtcgaggcacgtgtactttcaactatagattaacgcgaacgaggggtgagcgtaggtaggtagttcggttaggttttaatacgtgactagtacgagtaaacggtcaacgtcgtgggaccgttggggtaaccgttcgggaaccgtaaacggggaccgaagggtaaggtaaaacacgaaacgtaacgtggtacgcgtacgacacgtatcgtcttactacg

SEQ ID NO: 377733 - DNA, 430 bp, Homo sapiens
  misc_feature: GZ8MTXP02F9QSP.51.86.H09.1.454.CMB.2.raw
  modified_base (408)..(408): a, c, t, g, unknown or other
  modified_base (410)..(410): a, c, t, g, unknown or other
  modified_base (430)..(430): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacagccgcctcatctcctgcaggtctagtcaaggcctctatatagtgatggaaacacctacttgaattggttcagcagagccaggccaaatctaccaaagacgtacctaaatttataacggtttcaaaccggggacttcgtggggtacccagtacagattcagcgcagtgggtcaggcacgtgattcacactgatatcgacgaggtgagngngagtagtgttgttagttatn

SEQ ID NO: 377734 - DNA, 551 bp, Homo sapiens
  misc_feature: GZ8MTXP02JOO2S.51.86.H09.1.454.CMB.2.raw
  modified_base (429)..(429): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaatttataaggtttctaaaccgggactctggggtcccagacagatcagcgcagtgggtcaggcactgatttcacactgataatcgacagggtgaggctggaggatgttgggtttatactgcatgnaaggtacacacgtggccctggggaccgttcggaccgaaaacggggaccctaaagggtaggaaaacgtacgaaaaacggtaaacctggtacggccgtggaccaaccatacctgtacctttacg

SEQ ID NO: 377735 - DNA, 555 bp, Homo sapiens
  misc_feature: GZ8MTXP02IO72J.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctcaagacgcctaatttataaggtttctaaccgggactcgtgggtcccagacagattcagcgcagtggtcaggcactgatttcacactgataatcgaacgaggggtggaggctaggaggtattggtttagggtttatacgtgctaatgtacaaggtacaacgacgtggacctggggacgttcgggacgaaaggggacctaaagggtagaaaatcgaaaacgacgtggtacggctaggaacacccgattcgtgttcttcaattcccg

SEQ ID NO: 377736 - DNA, 575 bp, Homo sapiens
  misc_feature: GZ8MTXP02IST8I.51.86.H09.1.454.CMB.2.raw
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctaccaagacgcctaatttataaggtttctaaccgggactcgtggggtcccagacagattcagcggcaggtgggtcaggcactgattcactactgataaatcgacgagggtggagctggaggtatggttgggtttattacgtggctagtgacgtaaaggtaccacgacgtggacccgtggggtaccgttcgggacccgaaaaggggaccaaagggtacgggaaaacttacgaaaacggaacgtggttacggaactacggaccaacctataccgttgtacctttac

SEQ ID NO: 377737 - DNA, 570 bp, Homo sapiens
  misc_feature: GZ8MTXP02GEL3Y.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaatttataaggtttctaaccgggctcgtggggtcccagacagattcagcggcagtgggtcaggcactgatttcacactagataagtcgaacgaggggtgaggcgtggaggtattggtttagggttttattacgtggactagtgacgtaaaggtaccacgtacgtggccgttggggaccgttcgggaccgaaacggggaccgaaagggtaggaaaacgtacgaaaacgtactggtacgcgtaggaccactagtcgtcgttcttaccg

SEQ ID NO: 377738 - DNA, 555 bp, Homo sapiens
  misc_feature: GZ8MTXP02I4HAX.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacgcctaatttataaggtttctaaccgggactctggggtcccagacagattcagcggcagtgggtcagggcactgatttcacactgataatcgacagggtgaggctgaggtatgttgggttttatactgctatgacgtaaaggtaccaacgtacgtgggcccgtaggggtaccgttcgggaccgaaacggggaccgaaagggtacggaaaacttacgaaaacgtaacgtggaggcgtgaccacgatcgtcgttacttc

SEQ ID NO: 377739 - DNA, 531 bp, Homo sapiens
  misc_feature: GZ8MTXP02I35RS.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctactgaattggttcagcagaggccaggccaatctaccaagacgcctaatttataaggtttctaaccgggactcgtggggtcccagacagattcagcggcagtgggtcagggcactgatttcacactagataatcgacagggtgagctgaggtatgttggtttatactgctatgcgtaaaggtacacacgtggaccgtgggtaacgttcggaccaaacggggaccaaagggtggaaaatacgaaacgaactggtggctgacacatctgtacttc

SEQ ID NO: 377740 - DNA, 547 bp, Homo sapiens
  misc_feature: GZ8MTXP02FL5N7.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagagccaggccaatctcaagacgacctaatttataaggtttctaacgggactcgtggggtcccagacagattccagcggcagtgggtcaggcactgattcacactgaatatcgacgagggtggagctgaggtattggtttgggtttatacgtgcatgacgaaggttaccatacgtgggcctggggtacgttcgggacgaaggggaaccaaagggtacggaaaatacgaaaacgaactggtcggctaggccaaccgatctcgttctcactttcccg

SEQ ID NO: 377741 - DNA, 533 bp, Homo sapiens
  misc_feature: GZ8MTXP02IZVEQ.51.86.H09.1.454.CMB.2.raw
  modified_base (313)..(313): a, c, t, g, unknown or other
  modified_base (442)..(442): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaaatctccaagacgtcctaaatttanaaggttttcaaaccgggactctggggtcccagacagattcagcgcagtgggtcaggcactgatttcacactgataatcgacagggtgaggctgaggatgttggtttagttactgcatgcgaaagtacanactggccgtggacggttcgccgaacgggaccgaaggtacggaaagtacaaacgaactcgtaggcgtaggcaccaactccgtgtactttccg

SEQ ID NO: 377742 - DNA, 520 bp, Homo sapiens
  misc_feature: GZ8MTXP02FZKH2.51.86.H09.1.454.CMB.2.raw
  modified_base (309)..(309): a, c, t, g, unknown or other
  modified_base (373)..(373): a, c, t, g, unknown or other
  modified_base (386)..(386): a, c, t, g, unknown or other
  modified_base (396)..(396): a, c, t, g, unknown or other
  modified_base (512)..(512): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaaagacgcctaaatttanaaggtttctaaccgggactctggggtcccagacagatccagcgcagtggcaggcactgattcanactgataatcganagggtgaggntgagatgttgggtttatactgcagtgacaaggtacacacgtggcctggggtacgttcggaccgaaagggaccaaaggtggaaaatacgaaaacgaacgtgtaggctagcacatctntctcactc

SEQ ID NO: 377743 - DNA, 611 bp, Homo sapiens
  misc_feature: GZ8MTXP02JPB7O.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctacttgaattggttcagcagaggccaggccaatcctaccaagacgcctaaatttataacggtttacgaaaccgggactcgtcggggtccccaagactagacttcgagcggcaggttgggtccagggcctacgtgtatttacgacactagaataaagtcgaacgaggggtggagtcgtaggaggtagttggtttaggggttttaattacgtgtactagttagacgtaaaggtaccacgtacgtcgggtaccgtggggtaaccgttcgggaacccgaaaggggaacccgaaagggtacggaaaactacgaaaacgaacgtggtacgaacgtggaccacgtactctacgtctttacg

SEQ ID NO: 377744 - DNA, 574 bp, Homo sapiens
  misc_feature: GZ8MTXP02HV5J0.51.86.H09.1.454.CMB.2.raw
  modified_base (327)..(327): a, c, t, g, unknown or other
  modified_base (394)..(394): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatcctacaagacgcctaatttataaggtttcaaccgggntcgtggggtcccagacagattcagcggcaggtggtcaggcactgtattcgatactgaatatcgacgnggggtagaggcgtaggaggtattaggtttgggtttaattcgtagctagtgacgaaaggtacacgtacgtggccgttgggaccgttcggaccgtaaacggggaccgaaagggtacggaaaattacgaaaacgtaacgtggtaggaacttacggacctaaccgtattcgttcgttctttacg

SEQ ID NO: 377745 - DNA, 589 bp, Homo sapiens
  misc_feature: GZ8MTXP02FX5RK.51.86.H09.1.454.CMB.2.raw
  modified_base (253)..(253): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcagatctagtcaaggcctcctatatagtgatggaaacncctatgaattggttcagcagaggccaggccaatcctaccaaagaccgtaccttaaatttataaggtttctaaacccgggactcgtggggtccccagacagacttcgagcggcaggtgggtcagggcactgactttcaacactgaataatcgacgaggggtggaagctggagtagttggtttaggggttttattacgtgactagttgacgaaagggttacaacgtacgttgggcccgttagggggaaccgttcgggaaccgaaagggaccgaaagggtaggaaaactacgaaaacgaacgtggtggactcgacaacctagtctacgtcttactaccg

SEQ ID NO: 377746 - DNA, 561 bp, Homo sapiens
  misc_feature: GZ8MTXP02GHIWL.51.86.H09.1.454.CMB.2.raw
  modified_base (382)..(382): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaaatctccaagacgcctaaatttataaggtttctaaaccgggactctggggtcccagacagattcagcggcagtgggtcaggcactgatttcanactgataatcgacagggtgagctgagagtgttgggtttattactgctatgactaaggtacacgacgtggcctggggaccgtttacggacgaaacggggaccaaaggggtacggaaaacgtacgaaaacgaaaccgtggttacggcgttcggacacccaagttcctaggttacctttacg

SEQ ID NO: 377747 - DNA, 600 bp, Homo sapiens
  misc_feature: GZ8MTXP02HHGSD.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagagccaggcaatctccaagacgacctaatttataaggtttctaaaccggctcgtggggtcccaggtacacgattcagcggacaggtgggtcaggcacgtgactttcactactagaataatcgaacgaggggtgaggctaggagggtattggtttaggggtttaattacgtagtctagtgtaccgaaaggtaccacgtacgtaggtcccgtgggggtaccgttcgggaaccgtaaacggggaccgtaaagggttacggaaaacgttacgaaaacggaacctaggtagggaactacggcctaaccagttcgtacgttctttaccg

SEQ ID NO: 377748 - DNA, 588 bp, Homo sapiens
  misc_feature: GZ8MTXP02ILQ7A.51.86.H09.1.454.CMB.2.raw
  modified_base (297)..(297): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccaggtggggatgttgtgctgactcagtctccactctccctgcccgtcacccttggacagccggcctccatctcctgcaggtctagtcaaggcctctatatagtgataggaaacacctacttgaattggttcagcagaggcaggccaatcacaagacncctaatttataagtttacaaccggatcgtcgggtcccagacagattccagcgcaggtggcaggcacgtgatttcaactactagaataaacgtcgaacgtaggggtggaaggtgttaggaaggtagtttggtttagggttttacttaagtggatattagacgaaagggttacactacgtggcccgttaggggaccgttcggaccgaaagggaaccgaaaggtacggaaaagtacaaaacgtacgttaggtcggtcagaaccaaccgagtttcctcgttacctactacctccg

SEQ ID NO: 377749 - DNA, 526 bp, Homo sapiens
  misc_feature: GZ8MTXP02GXDH8.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagagccaggccaatctccaagacgcctaatttataaggtttctaaccgggactctggggtcccagacagatcagcgcagtgggtcaggcactgatttcacactgataatcgacgagggtgaggctgaggatgttgggtttatactgctatgacaaggtacacgactggctgggacgttcggaccgtaagggaccaaggtacggaaatacgaaaacgaactgtaggaactggacaccatcgtacgttcttac

SEQ ID NO: 377750 - DNA, 616 bp, Homo sapiens
  misc_feature: GZ8MTXP02H29NC.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacagccggcctccatcctcctgctaggtctagtcaaggccctctatatagtgataggaaacacctacttgtaattggttacagcagacggccaggccaatcctacaagaccgtacttaaatttagtaacggtttactaaccgggtactcgtacggggtcccagtacagattcgagcggcaggttggtcgaggccagtgtatttcgactactgaataacgtcgaacgaggggtggagcgtaggaggtattggttagggttttatcgtagtctagttgacgaaggtcaacgacgttcggaccgttgggtaccgtcgggaaccgtaaacggggtaccgaaagggttacggaaaactaacggaaaacggtaacgtgggtacggtcgtacggacctactacgttccgtacgttacctttaccg

SEQ ID NO: 377751 - DNA, 680 bp, Homo sapiens
  misc_feature: GZ8MTXP02GKPSJ.51.86.H09.1.454.CMB.2.raw
  modified_base (400)..(400): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgataggaaacacctacttgaattggttcagcagacggccaggccaatctacccaaagaccgtccttaaaattttataaacggtttcctaaaccggggacttcgtaggggtacccaagacagtattcaggcggcaggtggggcaggcagtgattcanactgataatcgacaggggtggagcgtaggaaggtatttggtttagggttttaattacgtgtacgtaagtggtaaccgtaaaagggtaaccaccgtacggttcgggtaccggttacgggggtaacccggtttccggggaaccccggtaaaacgggggtaaacccgtaaaagggggttaaacggaaaaacgttaaccgaaaaaccgggtaaaccgttgggttaacggaaccgttacggaacccgtaaacccgtaatttacccgttcgtttacctttaacccg

SEQ ID NO: 377752 - DNA, 660 bp, Homo sapiens
  misc_feature: GZ8MTXP02JIFGN.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagagccaggccaatctaccgaagacgaccttaaattttagtaaggtttacctaaccggggtactccggtggggtacccaggtacagtattccgagcggcaggttgggtcacggcacgtgactttcactacgtagataacgtacgaacgtagggggtaggaaggtcgtaggtaaggtagtttagggttttagggttttaagttaacgttggaccgtaagttacggtaccgtaaaagggttaaccaccgtaacggtcgggtaaccggtcgggggttaaccgttaccggggaacccggtaaaacggggtaacccgtaaaggggttaacggaaaacgttaaccgaaaacggtaacgtggtacgcgtagacctactatcgtctcttaccg

SEQ ID NO: 377753 - DNA, 540 bp, Homo sapiens
  misc_feature: GZ8MTXP02GKAX8.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccaagacgcctaatttataaggtttctaaccgggactcgtggggtcccagacagatcagcgcagtgggtcaggcactgattcacactgataatcgacagggtgagctgaggatgttgggtttatacgtgctatgactaaggtacacgacgtggccgtggggtacgttcgggaccgtaaacggggaccgaagggtacggaaaatacgaaaacgtaactggtaggcgtcgacaccgatctacgtcttac

SEQ ID NO: 377754 - DNA, 678 bp, Homo sapiens
  misc_feature: GZ8MTXP02JXH5A.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgataggaaacacctacttgaattggttcagcagaggccaggccaatctaccaagacaccttaatttataacggtttactaaccggactcgtcggggtcccagacagacttcgaggcggcaggtcgggtcgagggcctacgtgtactttacaactactagtaaataaagtccggaacggtagggggtacgggagggtcgtaggaaggttagttaggttttaggggtttttaattaacgtgacgtagttacgggacgtaaacgggttaccaacggtacgttacggggtaccgttacgggggtaccggtttaccgggaacccggtaaaacgggggaacccggtaaaaggggttaacgggaaaacttaaccggaaaacgtaaccgttaggtacggaacgttacggacgtaccgtacgttccgtacgttcctttaaccg

SEQ ID NO: 377755 - DNA, 532 bp, Homo sapiens
  misc_feature: GZ8MTXP02GMSDI.51.86.H09.1.454.CMB.2.raw
  modified_base (256)..(256): a, c, t, g, unknown or other
  modified_base (277)..(277): a, c, t, g, unknown or other
  modified_base (288)..(288): a, c, t, g, unknown or other
  modified_base (305)..(305): a, c, t, g, unknown or other
  modified_base (374)..(374): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacnctactgaattggttcagcagngccaggccaanctcaagcgctaatttanaagtttcaaccggctctgggtccagacagatcagcgcagtgggcaggcactgatttcacactgataaancgacgagggtggagctgaggtatgttgggtttatacgtgctagtgacaaggtacacgactggccgtggggacgtttcggacgaacggggaccgaaagggtacggaaaatacgaaaacgtaacgtcgtagggaactcggacaccatccgtgtacctttc

SEQ ID NO: 377756 - DNA, 562 bp, Homo sapiens
  misc_feature: GZ8MTXP02ICT25.51.86.H09.1.454.CMB.2.raw
  modified_base (188)..(188): a, c, t, g, unknown or other
  modified_base (254)..(254): a, c, t, g, unknown or other
  modified_base (400)..(400): a, c, t, g, unknown or other
  modified_base (423)..(423): a, c, t, g, unknown or other
tcagcgatcgtatacacgaccggtgctcgatttagtgctatagacttgggtttgggactgatcaggactcctcagttcaccttctcacaatgaggctcctgctcagctcctggggctgctaatgctctgggtcccaggttccagtggggatgttgtgctgactcagtctccactctccctgccccgtnacccttggacagccggcttccatctcctgcaggtctagtcaaggcctctatatagtgatggaaacnctacttgaattggttcagaagaggccaggccaatctccaaagaccgaccttaaatttataaaggttttcctaaacccggggacttcgtggggtaccccagtacagacttcgagcggcagtgggcaggcatgatttcacatgataancgacgagggtggaggctggaggnttggttgggtttatactgcagttgactaaggtacacgacgtggccgtaggggtacttacgggaccgaaaaggggaccgaaaagggtggaaaacttacgaaaacgtactggtgacgtgcaacgtactctcgtactttcac

SEQ ID NO: 377757 - DNA, 545 bp, Homo sapiens
  misc_feature: GZ8MTXP02F1YAX.51.86.H09.1.454.CMB.2.raw
  modified_base (409)..(409): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacgcctaatttataaggtttctaaaccgggactcgtggggtcccagacagattcagcggcagtgggtcaggcagtgatttcacactgataatcgacgagggtgagctgaggntgttggtttatactgcatgacaaggtacacgacgtcggaccgtgggaacgttcgggaccgtaaaggggaccaagggtacggaaaactcgaaaacggtaactggtacgcgtacggacacctatccgtgttactttcc

SEQ ID NO: 377758 - DNA, 600 bp, Homo sapiens
  misc_feature: GZ8MTXP02JO5YI.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacacctactgtaattggttcagcaggacggccaggaccaatcctaccaagaccgaccttaaatttagtaacggtttcctaaaccgggactcgtcggggtcccaagacagatcagcgcaggtgggtcaggcacgtgtatttcaactatgtaataatcgaacgaggggtggagtcgtaggagtagttggtttgggttttaatacgtgactagtcgacgtaaggtacacgtacgtcggtacgtggggtaccgtacggaccgtaacggggaaccgtaaaggggtacgaaaacttacgaaaacggtacgtaggtacggtcgtacgaccgtaccattccgtcgttaccttccg

SEQ ID NO: 377759 - DNA, 782 bp, Homo sapiens
  misc_feature: GZ8MTXP02HRSJK.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagcccggcctccatctcctgcaggtctagtcaaggcctctatatagtgataggaaactacctacttagaattggtttacagcaggaggccaggccaaatcctaccaaagaccgtacctttaaagttttaacgttaaacgggtttacctaaacccggggtacttccggttacccgggggtacccccaaggtaaccaggtaatttcccggaagggcccggggacgtaaagggttcgggggtaccaagggggccctaaacttgggtaacttttaccgaacgtaaccttaggtaaacttaaagttacccggaacggtaagggggttcggggtaaacggggtacggtagggtagggttaggtttagggtttttaggggtttttaacgtttacgttacggtacgtacgtacggtaacggtaaacggtaacgtaaccgtacgtacgggtaccgggtacggggttaccgggttaccgggtaaccgggtaaacgggtaaaccggtaaacgggtaacggtaaacgtaaaccgtaaaacggtaaacggtacggtacggtacgtacgtaccgtaaccgtaacg

SEQ ID NO: 377760 - DNA, 589 bp, Homo sapiens
  misc_feature: GZ8MTXP02HIR9Z.51.86.H09.1.454.CMB.2.raw
  modified_base (259)..(259): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtnataggaaacacctacttgaattggttcagcagagccaggccaatctcaagacgccttaattataaggtttctaaccggactcgtcggggtcccagacagatcagcggcagtggtacaggcacgtgattcactactagataatcgagagggtgagctaggaggtattggtttggggtttttaatacgtggtactagttagacgtaaaggtacaacgtacgtcggaccgttcgggaccggtttccggacccggtaaagggaacccgtaaagggtaacggaaaacgtaccgaaaacggtaacgtaggtaacgcgttacgaccgaaccgtaacg

SEQ ID NO: 377761 - DNA, 586 bp, Homo sapiens
  misc_feature: GZ8MTXP02JR6O0.51.86.H09.1.454.CMB.2.raw
  modified_base (268)..(268): a, c, t, g, unknown or other
  modified_base (364)..(364): a, c, t, g, unknown or other
  modified_base (373)..(373): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacncctacttgaattggttcagcaggaggccaggcaatctacaagacgccttaaatttataaggtttcctaaaccgggctcgtcggggtcccagacagnttcgagcgnaggtggcaggcactgatttcatactgataatcgacgaggggtagagctggaggtatttggtttgggttttatacgtggactagtgtacgtaaggtacacgtacgtcggaccgttacggggtaccggttcggaccggtaaaggggaaccgtaacggggttaagaaacgtaacgaaaacgtaacgtggtacgggtactacggacctaaccgtacg

SEQ ID NO: 377762 - DNA, 577 bp, Homo sapiens
  misc_feature: GZ8MTXP02F6VSC.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagcccggcctccatctcctgcaggtctagtcaaggcctctatatagtgatggaaacacctacttgaattggttcagcagaggccaggccaatctccaagacgccttaaatttataaggtttcctaaaccgggtctcgtcggggtcccagacagattcgagcggcaggtgggtcagggcactgtatttcactactgataagtcgacgaggggtggaggcgtggaggtagttggtttagggttttattacgtgactagtgacgtaaggtacacgacgtcggccgtggggaccgttcggaccgaaacgggaccgaaaggggtacgtaaaacacgaaaacgtaacgtggtacggctacggaccacgtatcgtcgtctttacg

SEQ ID NO: 377763 - DNA, 540 bp, Homo sapiens
  misc_feature: GZ8MTXP02ILS3H.51.86.H09.1.454.CMB.2.raw
  modified_base (254)..(254): a, c, t, g, unknown or other
  modified_base (270)..(270): a, c, t, g, unknown or other
  modified_base (283)..(283): a, c, t, g, unknown or other
  modified_base (288)..(288): a, c, t, g, unknown or other
  modified_base (324)..(324): a, c, t, g, unknown or other
  modified_base (344)..(344): a, c, t, g, unknown or other
  modified_base (377)..(377): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaacnctacttgtatagtttnagcagagcagcanctcanacgctattatagttactacgactctggtccgacganacgatcagcgcagtggtcgngcactcgtattcacactagataaatgacgaggnggaggctgagatgttggtttatatgcatgtcaaggtacacagtggcgtggtaccgtcggacccgaaagggaccgaaagggtaggaaaacgtaccgtaaaacggaaaaccgttgttaacgggcgttacgccgtaacgtaactttccgttggttccctttaaccg

SEQ ID NO: 377764 - DNA, 641 bp, Homo sapiens
  misc_feature: GZ8MTXP02GCP31.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatgaaacacctacttgaattggttcagcagaggccaggccaaatctccaaagacgtacctaaattttataaaggtttcctaaaccggggacttcgtggggtcccagacagtatcagcggcaggtgggtcagggcacgtgatttcaacactgaataatcgaacaggggtggaaggcgtagaggtattaggtttcgggttttattaacgtggtactagtagacgaaaggtaacaccgtacgtcgggtaccgtcggggtaacggttccgggaccgtaaaacgggggaacccaaaaggggttaacgggaaaaacttaaccgaaaaaccgggtaaccgtagggttaggggaaccttacggaaccaaacccggtattaccgttcggtttacctttaacccg

SEQ ID NO: 377765 - DNA, 647 bp, Homo sapiens
  misc_feature: GZ8MTXP02G8FKZ.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatcctaccaagacgtacctaaatttacgtaaggtttccaaacgggctcgtcggggtcccagacagtatcgagcgcagtgggtcaggcactgtacttcactactagaataagtcgaagtaggggtagaggtcgtaggaaggtagttggtttagggttttaaattacgtagcgtaagtgaacgtaaaggttaccaacgtacggttcgggtaccggttacggggtaaccggttccgggaacccggtaaaacggggaacccgtaaagggggttaaacgaaaaacgttaccgaaaaacggtaaccgtgggttacggaaccgttacggaacccgtacgtaacttccgttcggttaccttaacccg

SEQ ID NO: 377766 - DNA, 552 bp, Homo sapiens
  misc_feature: GZ8MTXP02HSG54.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacactacttgaattggttcagcagaggccaggccaatctccaagacgccttaatttataaggtttctaaccgggactcgtggggtcccagacagattcagcggcaggtgggtcaggcactgtattcacactgaataatcgacgagggtgaggctggaggtattggtttagggttttattacgtgtactatgacaaggtacacgacgtggaccgtgggacgttcggacgaacgggaccgaaaggtacggaaatacgaaaacgtaacgtaggtggctcgactaccgatcgtacgttcttac

SEQ ID NO: 377767 - DNA, 600 bp, Homo sapiens
  misc_feature: GZ8MTXP02IMXXY.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactacttgaattgttcagcagagccaggccaatctacaagacgacctaatttataacggtttctaaccgggactcgtggggtcccagacagattcagcgcagtgggtcgaggcacgtgtactttcactactagataaatcgaacgtaggggtaggaggcgtaggaaggtagttagggtttagggtttttaaattacgttaggactagttagaccgtaaagggttaccacgtaacgttcgggtaccgttgggggtaccgttacgggacccgaaaacggggtaccgtaaagggtaggtaaaactacaaaacgaaacgtgtaggcctagactacatctacgtacttacg

SEQ ID NO: 377768 - DNA, 521 bp, Homo sapiens
  misc_feature: GZ8MTXP02FKL9W.51.86.H09.1.454.CMB.2.raw
  modified_base (254)..(254): a, c, t, g, unknown or other
  modified_base (285)..(285): a, c, t, g, unknown or other
  modified_base (407)..(407): a, c, t, g, unknown or other
  modified_base (503)..(503): a, c, t, g, unknown or other
  modified_base (506)..(506): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggctccatctcctgcaggtctagtcaaggcctctatatagtgataggaacncctacttgaattggttcagcagagcagccanctacaagcgactaattataaggtttctaaccgggatcgtggggtccagtacagatcagtcggcaggtgggtcaaggcactgtattcacactgaataagtcgacgagggtggagctgaaggtntggtttggtttatacgtgctaatgacgaaggtacacacgttcggcctaggggacgtcgaacgaacggaaccaggtaacgaaatacaaacgactggngcncacacactctctctc

SEQ ID NO: 377769 - DNA, 629 bp, Homo sapiens
  misc_feature: GZ8MTXP02JGOT4.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctattgaattggttcagcagagccaggccaatctacaagcgctaatttatagtttcaaccggtactcgtgggtacccagacagtatccgagcggcaggtggtcagggcactgtactttcacgtactagataagtcgacgaggggtcgaggcgtagaggtatttgggtttagggttttattacgtggtactagtggtaacgtaaagggttaaccacgtacggttcgggacccggttagggggtaccgtttaccggggaccgaaaacggggtacccgtaaaagggggtacggtaaaactaaccggaaaacggtacgtacggtacggtccttaggaaccctaccgtattcgtacgttcctttaacgtactttcccccg

SEQ ID NO: 377770 - DNA, 609 bp, Homo sapiens
  misc_feature: GZ8MTXP02IF65Z.51.86.H09.1.454.CMB.2.raw
  modified_base (255)..(255): a, c, t, g, unknown or other
  modified_base (290)..(290): a, c, t, g, unknown or other
  modified_base (385)..(385): a, c, t, g, unknown or other
  modified_base (392)..(392): a, c, t, g, unknown or other
tcagcgatcgtatacacgaccggtgctcgatttagtgctatagacttgggtttggggactgatcaggactccctcagttcaccttctcacaatgaggctccctgctcagctcctggggctgctaatgctctgggtcccaggttccagtggggatgttgtgctgactcagtctccactctccctgccccgtcacccttggacagccggcctccatctcctgcaggtctagtcaagcctctatatagtgatgaaacncctattgaattgttcagcagagccagccatctcanacgctaatttataggtttcaaccggactctgggtcccagacagatcagcgcagtgggtcaggcactgatttcacgtactgataatacgagagggnggagggngtagtaggtagttaggtttaggtttagtttacgttacgtacgtagtacgtacgtaacggtaacgtaacgtacgtacggtaccggttacgggtacgggtaccgggtaaccggtaaacgggaaaccggtaaacgggtaaacggtaaaacgtaaacgtaaaacgtaaacgtaaggtacggtaacgtacgtaccgtaccgtactacgttacgttacttacg

SEQ ID NO: 377771 - DNA, 630 bp, Homo sapiens
  misc_feature: GZ8MTXP02HJOD4.51.86.H09.1.454.CMB.2.raw
  modified_base (422)..(422): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgataggaaacacctacttgaattggttcagcagaggccagccaatctaccaaagaccgaccttaaatttagtaacggtttcctaaaccgggctcgtcggggtcccaagacagacttcgagcggcaggtgggtcgaggcaactgatttcaactatagataagtcgacgagggtggaggngtaggagtagttggtttaggttttaattagtgactagtagtaacgtaacgtaacacgtacgtcggtacggtacggggtaccgttaccggaaccggtaaaacggggaacggtaaaagggtaaacggtaaaacgtaaaccgaaaacggtaacgttaggtacggtaaccgtacgaacccgtaactacgtttaccgtacgtttaccttaccg

SEQ ID NO: 377772 - DNA, 674 bp, Homo sapiens
  misc_feature: GZ8MTXP02IBB9G.51.86.H09.1.454.CMB.2.raw
  modified_base (242)..(242): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagccgcctccatctcctgcaggtctagtcaagcctctatatagtnataggaaacacctacttgaattggttacagcgagacggccaggccaatctaccaaagaccgtacctaaatttaagtaacggtttaccgaaaccgggtactcggtacggggtccccaaagaccagattccgaggcggacagggtggtcagggcaacgttgtactttcaactactagaataagtccgaagaggggtaggaaggcttaggaggtatttgggtttacgggttttataacgtggatagtacggtaactaaagggtaccacgtacggtacgggtccgttagggggaaccggtttccggaaccgaaaacggggaaccgtaaaagggtaaagggaaaacttaaaccgaaaaacggtaaacgttggacgggtacctacggaacccgtaacctaagttaccttcgttacccgtttactaacctttacccccg

SEQ ID NO: 377773 - DNA, 514 bp, Homo sapiens
  misc_feature: GZ8MTXP02G8BFO.51.86.H09.1.454.CMB.2.raw
  modified_base (290)..(290): a, c, t, g, unknown or other
  modified_base (403)..(403): a, c, t, g, unknown or other
  modified_base (405)..(405): a, c, t, g, unknown or other
  modified_base (425)..(425): a, c, t, g, unknown or other
  modified_base (427)..(427): a, c, t, g, unknown or other
  modified_base (430)..(430): a, c, t, g, unknown or other
  modified_base (445)..(445): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctcctatatagtgatggaaacacctacttgaattggttcagcagagccaggccaatcnccaaagacgcctaaatttataaggtttcaaaccgggactcgtggggtcccagacagattcagcggcagtgggtcaggcactgatttcacactgataaatcgagagggtgaggngngagagtgttgttagttatgnanganagacacacgtcgcgnggtacgtcgacgaacggaacgaaggaacgaagaacgaacgaacgtagtagcgcgacacactactctctc

SEQ ID NO: 377774 - DNA, 653 bp, Homo sapiens
  misc_feature: GZ8MTXP02F7K9S.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctattgaattggttcagcagaggccaggccaatctaccaagacgcctaatttataaggtttcaaccgggactcgtggggtcccagacagattccagcgcagtggtcagggcactgatttcacactgaataatcgaacgaggggtggaggtcgtggaggtagttggtttaggggttttaacttacgttgacgtagttggacgtaaacgggttaacaccgaacgttcggggtaccccgttgggggtaaccgtttccggggaccggtaaaacgggggaacccgtaaaagggggttaacggaaaaacgttaccgaaaaaaccgggtaacgttagggttaacggcgttacggaaccaaaccccgtatttcccgttaggtttccctttacgtaaccgtttcccccg

SEQ ID NO: 377775 - DNA, 582 bp, Homo sapiens
  misc_feature: GZ8MTXP02IB2BZ.51.86.H09.1.454.CMB.2.raw
  modified_base (350)..(350): a, c, t, g, unknown or other
  modified_base (398)..(398): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgataggaaacactatgaattggttcagcagagccaggcaatctacaagacgtactaatttataaggtttcaaaccgggctcgtcggggtccagacagattcagcgnaggtgggcaggcactgattcactactagaataactacggacgaggggnggaacggtgtaggaaggtagtttagggtttagggttttaattacgttgactagtagaacgtaagggtacacgtagtcggcggtacgggtacgttaccgggacgaaacgggaaccgaaagggtaacgaaacgtaacgaaaacgtacgttgacgggctgaccgtactacgtccgtcgttactaccg

SEQ ID NO: 377776 - DNA, 572 bp, Homo sapiens
  misc_feature: GZ8MTXP02I476R.51.86.H09.1.454.CMB.2.raw
  modified_base (255)..(255): a, c, t, g, unknown or other
  modified_base (359)..(359): a, c, t, g, unknown or other
  modified_base (367)..(367): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacnctacttgaattggttcagcagaggccaggccaatctccaagacgacctaaatttataaggttttccaaaccggggactcgtggggtcccagacagattcagcgnagtgggtnaggcactgatttcacactgataaatcgacgagggtggaggcgtggaggtagtgttaggggtttattactgcatgctaaggtaccaactacgtcggccgtaggggaccgttcggaaccgtaacggggaacccaaaggggtacggaaaactacggaaaaacgtaccttaggacggctggaccgacctactaccgttacgttactacg

SEQ ID NO: 377777 - DNA, 621 bp, Homo sapiens
  misc_feature: GZ8MTXP02HCW8A.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggccctctatatagtgatggaaacacctacttgaattggttcagcaggaggccaggccaatctacaagacacctaatttagtaacggtttctaaccgggactcgtggggtacccaggacagattcagcggcaggtcgggtcgaggcacgtgtatttcactactagaataagtacgacgaggggtggaggtcgtaggagggtagttaggtttggggttttaatacgttgtacgtagtcggacgtaaaggtaacacgtaacgtcgggtaccgtggggtaccgttcgggaacccgtaacggggaaaccggtaaacgggtaacggaaaacgttaccgaaaacgtaaccgttaggtacggaacgtagaccgactacgtcctacggttctttaccg

SEQ ID NO: 377778 - DNA, 523 bp, Homo sapiens
  misc_feature: GZ8MTXP02HODZ2.51.86.H09.1.454.CMB.2.raw
  modified_base (353)..(353): a, c, t, g, unknown or other
  modified_base (422)..(422): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacgctaaatttataaggtttctaacgggatcgtggggtcccagacagattcagcgnagtgggtcaggcatgattcacactgataaatcgagagggtgagcgtgagagtgttggtttagttatgtntatgagagtacacacgtgcgtggtacgtacgtacgaacggacgaaggacggaaagaacgaaacgaacgtaaggagaacgtacgacgacactactcgtactc

SEQ ID NO: 377779 - DNA, 588 bp, Homo sapiens
  misc_feature: GZ8MTXP02GBZFM.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccgatctaccaagacgccttaaatttataaggtttcaaccgggactcgtgggtcccagacagtatccagcggcaggtggtacaggcactgtatttcactactagaataagtcgaacgaggggtaggaggtcgtaggaggtagtttggtttagggttttatacgttggactagttgacgtaaggttacacgtacgtcgggtccgtaggggtacgttcggaccgtaaagggaccgtaaggtagaaactacgaaaacgtacgtggtacgcgtacgaacctaccgtattctgtaccttacgactttcccg

SEQ ID NO: 377780 - DNA, 562 bp, Homo sapiens
  misc_feature: GZ8MTXP02H441Y.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacagccggcctccatctcctgcaggtctagtcaaggcctctatatagtgatggaacactacttgaattggttcagcagaggccaggccaatctaccaagaccgaccttaaatttataaggtttctaaaccggggactcgtcggggtcccagacagattcgagcggcaggtgggtcagggcactgatttcacactagataatcgacgaggggtgaggctggaggtagttggttgggttttatacgtgactagtgacgaaggtacactacgtggccgtggggacgttcggacccgaaaggggaccgaaagggtagaaaacgtacaaaacgaacgttggtggccgtgactaccatccttgtactttc

SEQ ID NO: 377781 - DNA, 562 bp, Homo sapiens
  misc_feature: GZ8MTXP02HXIN4.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctacttgaattggttcagcagaggccaggccaatctcaagacgctaatttataaggtttctaaacgggctcgtggggtcccagacagattcagcggcaggtgggcaggcactgatttcacactgataatcgacgagggtgaggctggaaggattggtttagggtttattacgtgactagtgacgaaaggtacaacacgtcggcgtggggtaccgttacggaccgaaacggggtaccaaagggtaacgaaaacgtacgaaaaacggacgtaggtcggaacgtcggaccactatcgttcgtacttacc

SEQ ID NO: 377782 - DNA, 541 bp, Homo sapiens
  misc_feature: GZ8MTXP02G6D14.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctactatatagtgataggaaacactactgaattggttcagcagagccagccaatctacaagacgactaatttataaggtttacaaaccgggactcgtggggtccagacagattcagcgcaggtggtcaggcacgtgtatttcaacactgaataaatcgaacgaggggtagaggctgaggagttgtttgggtttaattacgtgacgtatgacgaaagtacacgagtgtaccgtgggacgtcgaccgaaagggaccgaaaggtacgaaatacgaaaacgaactagtacgcgtagaccacatctgtacttac

SEQ ID NO: 377783 - DNA, 566 bp, Homo sapiens
  misc_feature: GZ8MTXP02GGDBO.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctaccaagacgaccttaaatttataaggtttctaaaccgggctcgtggggtcccagacagattccagcgcaggtgggtcaggcactgtatttcactactgataagtcgacgaggggtggaggcgtaggaggtagttggtttgggttttaatacgttgactagttgacgtaaaggtacacgacgtcggccgtggggtacgtcggaccgaaagggaccgaaggtacggaaatacgaaacgaacgtgacggctggaacacgtatactcgtactctacttccc

SEQ ID NO: 377784 - DNA, 559 bp, Homo sapiens
  misc_feature: GZ8MTXP02IC69Z.51.86.H09.1.454.CMB.2.raw
  modified_base (255)..(255): a, c, t, g, unknown or other
  modified_base (397)..(397): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacnctatgaattggttcagcagaggccaggccaatctccaagaccgaccttaatttagtaaggtttcaaaccgggtatcgtggggtcccagacagattcagcgcaggtcgggtcaggcacgtgactttcactactgataatcganaggggtgaggctgaggtattgttagggtttattactgctagtgacaaggtcaacgcgtgggaccgttgggtacgttacggaccgaaacggggaccgtaaagggtagaaaacgtaacgaaacgtaacgtgtacggaactcgaccacctatcgtcgttccttac

SEQ ID NO: 377785 - DNA, 619 bp, Homo sapiens
  misc_feature: GZ8MTXP02GY3AX.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacnctacttgaattggttcagcagaggccaggccaatctaccaagaccgctaaattttagtaaggtttcctaaaccgggacttcgtggggtcccagacagattcgagcggcaggtggtcaggcacttgactttcactactgaataagtcgaacgtaggggtagaggctaggagggtaattggtttagggttttaacttgttggctagtgacgtaaaggtaccacgtaaccgtgggtacgtcgggggtaaccgtttccgggaaccggtaaaacgggggaccccgaaaagggggttacggaaaaactacggaaaaaccgtaacgtaggtaacggcgtaggaccactaacgtcttacggttactttaccg

SEQ ID NO: 377786 - DNA, 591 bp, Homo sapiens
  misc_feature: GZ8MTXP02JLNWE.51.86.H09.1.454.CMB.2.raw
  modified_base (266)..(266): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatggaaacncctacttgaattggttcagcagagccaggccaatctcaagcaccttaatttataaggtttcaaccgggatcgtcggggtcccagacagattcagcggcaggtcggggtcagggcaacgtgtactttcgaacactgaattaacgtcgacgaggggtggaggtcgtaggaggtagttggtttgggttttaattacgtgactagtgacgtaaaggtacacgtacgtggccgtagggtaccgttcgggacccgaaagggtaccgaaggtaacggtaaacgtaccgaaaacggtacgttagggtacggtactacggacccgtacgtaacg

SEQ ID NO: 377787 - DNA, 646 bp, Homo sapiens
  misc_feature: GZ8MTXP02H5LOG.51.86.H09.1.454.CMB.2.raw
  modified_base (441)..(441): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgataggaaacacctacttgaattggttcagcagagccaggccaatctacaagcgtaccttaaatttataaggtttcctaaccgggctcgtcggggtcccagacagtattcagcgcaggtcgggtcagggcactgtactttacactactagtactaaagttcgaacggaggggttggaacgggngtaggaagggtagtttaggttttaggggtttttaattacgtggtcgtagtacggacgtaaagggtacaaaccgtcggtacgggtccgttacgggggtaccggtttacggggacccgtaaacgggggaaacccgtaaaggggttacggaaaacgttaccgaaaaacggtacccgtaggttacgggctacggacctaaccgttaacg

SEQ ID NO: 377788 - DNA, 600 bp, Homo sapiens
  misc_feature: GZ8MTXP02HBDD0.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctgggctgctaatgctctgggtcccaggttccagtggggatgttgtgctgactcagtctccactctccctgcccgtcacccttggacagccgcctccatctcctgcaggtctagtcaaggcctctatatagtgatggaaacacctacttgaattggttcagcagagccaggccaatctaccaaagaccgtacccttaaatttataaggtttaccaaaccgggtacgtacgtccggggtaccctacgacgagattacacgcggcgaggtcgggtcgaggcacgtgtactttctactactagtaactaatacggacgaggggtaggaggacgtaggtaggtagtttggtttgggtttaagttactgtactagtgacgaaggtacgacgagtcggccgtacgggtacgtcggaccgaacgggaaccgtaggtaaggtaaactaacgaaacgaacgtacggtcggactcggacgactaacg

SEQ ID NO: 377789 - DNA, 568 bp, Homo sapiens
  misc_feature: GZ8MTXP02GVT1M.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctattgaattggttcagcagaggccaggccaatctccaaagacgacctaaatttataaggtttctaaccgggactcgtggggtcccagacagattcagcggcagtgggcaggcactgatttcacactagaataaatcgacgaggggtggaggcgtaggaggtattggtttagggttttattacgtgactattacgaaggtacacgacgtggctggggtacgttcggacgaagggaaccgaaagggtagaaaacgtacaaaacggtaacgtggtacggctaaggaccaacctatcctgtacctttactaccg

SEQ ID NO: 377790 - DNA, 674 bp, Homo sapiens
  misc_feature: GZ8MTXP02HZA4T.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatcctcctgcaggtctagtcaaggcctctatatagtgataggaaactacctactgtaattggttcagcaggacggccaggccaatcctaccaagaccgtaccttaattttaagtaacggtttaccgtaaaccgggtacttcgtacggggtaccccaaggactacgtacttacgaggtcggctagggttcgggtcgagggactacgtgtactttcgactacgtagaataactcggaacgtaggggtagaggtcgtaggaagggtagtttggtttaggggtttttaacttacggtaggtactagttcggactaaagggtaccacgtaacgtcgggacgttaggggtaccgttacggaacccggtaaaacggggaccgtaaaggggtacgtaaaaactaccgaaaacggtaacgtggtacggaacgttacggaacctaccgtaagttccgttacgtttacctaaccg

SEQ ID NO: 377791 - DNA, 638 bp, Homo sapiens
  misc_feature: GZ8MTXP02H6EP8.51.86.H09.1.454.CMB.2.raw
  modified_base (255)..(255): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgccctcacccttggacagccggcctccatcctcctgcaggtctagtcaaggcctctatatagtgataggaaacncctatgaattggttcagcagaggccaggccaaatcctaccaagaccgtaccttaaatttaagttaaacggtttccgaaaccggggtactcggtacggggtaccccaaggacagattcgagcggcaggtgggtcagggcacgtgtatttcgaactactagaataagtcgaacgtaggggtggaggtcgtaggaggtatttggtttagggtttattacgtgactagtagacgtaaggtacaacgtacgtgggtacccgtaggggtaaccgttaccgggaacccggtaaaaggggaaacccgtaaaggggtaaacggtaaaaacgtaaccgaaaaaccgtacgttggtacggaactacggacctaccgtattccgtagttcctacg

SEQ ID NO: 377792 - DNA, 543 bp, Homo sapiens
  misc_feature: GZ8MTXP02JN09H.51.86.H09.1.454.CMB.2.raw
  modified_base (537)..(537): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagcaggcctccatctcctgcaggtctagtcaaggcctcctatatagtgatggaaacacctacttgaattggtttcagcagaggccaggccaatctccaagacgcctaatttataaggtttctaaccgggactcgtggggtcccagaccagattcagcggcagtggggtcaggcactgatttcacactgaataatcgacgaggggtggaggctggaggtattggtttagggtttatacgtgctagtgacaaggtacacgacgtggcctaggggacgttcggaccgaaagggaccaagggtagaaactcgaaaacgactggtgactgacaccgattccgngttacc

SEQ ID NO: 377793 - DNA, 640 bp, Homo sapiens
  misc_feature: GZ8MTXP02IQEE3.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatcctcctgcaggtctagtcaaggcctctatatagtgataggaaacacctacttgaattggttcagcagagccaggccaatctaccaaagacgtaccttaaatttacgtaacggtttacgaaccgggtactcgtacggggtcccaagacctagtattcgagcggacaggttcgggtcagggactacgtagtatttacaactacgtagaaattaaacgtcgaacgtagggggttagaggtcgtaggaggtagttggtttaggggtttttaaatcgtgactagttacggacgtaaagtaccacgtacgtgggtacccgtaggggtaccgttcgggaacgtaaacggggaaccgtaaaggggtaacgaaaataacggaaaacgtacgttggacggcgtacggaacctacgtacgttactcgttacctttaacg

SEQ ID NO: 377794 - DNA, 630 bp, Homo sapiens
  misc_feature: GZ8MTXP02GGHJ0.51.86.H09.1.454.CMB.2.raw
  modified_base (275)..(275): a, c, t, g, unknown or other
  modified_base (587)..(587): a, c, t, g, unknown or other
  modified_base (613)..(613): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatagaaacacctattgaattggttcagcagngccaggccaaatcctaccaaagacgtaccttaaagtttactaacggtttacctaaaccgggacttcgtcggggtacccaaggacagtattccgagtcggcaggttgggtcaggctaagttgtactttacgaactatagaataaagtcgaacgagggtaggagtcgtaggaggtagttaggtttacgggttttaatacgtagtacgtagttacgtaacgtaaacggttaaccacgtacgtcgggtacgtacggggtaacgtccggaacgtaaacgggaccgaaagggtaacgaaactaacgaaacgttaacgnggtacgaacgtacgaccgtaaacctnttacgtacgtacgttac

SEQ ID NO: 377795 - DNA, 612 bp, Homo sapiens
  misc_feature: GZ8MTXP02F12ND.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctattgaattggttcagcagaggccaggccaatctaccaagaccgtacccttaaattttagtaaacggttttcctaaaccggggtacttcgtcgggggtccccaaggaacctagtacttccgaaggtccgggacagggttggggtccagggcacgttgatttcacactgaattaaacgtcgaacgaggggtggaggtctaggaggtattggtttgggttttatacgtgctagtgacgtaaaggtacacgtacgtgggccgtaggggtacgttcggaccgaaacggggaccgaaagggtacggaaaactcgaaaacgtacgtggtacggctacgactaccgattctacgtctttacg

SEQ ID NO: 377796 - DNA, 564 bp, Homo sapiens
  misc_feature: GZ8MTXP02GN8ZK.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaaatctccaaagacgtaccttaaattttataaaggttttcctaaaccggggtctcgtggggtccccagacagattcagcggcagtgggtcaggcactgatttcacactagataaatcgaacgagggtggaggcgtaggaggtattggttagggtttttaattactaggtctatgacaaggtacacgacgtggcctggggacgttcggaccgaagggaccaaagggtagaaaatcgaaaacgacgtggtaggcgtggactacgatcgtcgtacttcg

SEQ ID NO: 377797 - DNA, 539 bp, Homo sapiens
  misc_feature: GZ8MTXP02F9PYM.51.86.H09.1.454.CMB.2.raw
  modified_base (384)..(384): a, c, t, g, unknown or other
  modified_base (417)..(417): a, c, t, g, unknown or other
  modified_base (446)..(446): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctaccaagacgccttaaatttataaaggtttcctaaccgggactcgtcggggtccagacagattcagcggcagtgggtcaggcactgatttcanactagataatcgacgaggggtgaggctgaggtntgttggtttatactgcatgacaaggtcanacgtggcctgggacgtcggacgaaacggggtaccaaagggtcggaaaactacgaaaacgaacgtgttaggctgacaccattcctgtctttacg

SEQ ID NO: 377798 - DNA, 763 bp, Homo sapiens
  misc_feature: GZ8MTXP02IVZJ0.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtgggatgttgtgctgactcagtctccactctccctgcccgtcacccttggacagccggcctccatctcctgcaggtctagtcaaggcctctatatagtgatggaaacactattgaattggttcagcagaggcccaggccaatctaccaaagaccgtccttaaattttagtaaaggttttccgtaaaccggggacttccgtacggggtcccccaagaccaaggactttcccgaggtcgggacgaagggttcggggtaccaaggggcctaacgttcggtaactttttcccaaccgtaactagaaacttaaagttcggaacggtaagggggttggggaacgggtcgtagggagggtagtttaggggttttaggggtttttaattacgttggtacctaggttacgtacgtaaagggttaccaaccgtaccggtacgggtcccggttagggggtaaccggtttccggggaacccggtaaaacgggggaaccccgtaaaagggggttacggggaaaaaacttaccggaaaaaaaccgggtaaccgtttaggggtaacgggtccgttacggaacccgaacccgtaaagtttcccgttaggtttccctttaccgtaacctttcccccg

SEQ ID NO: 377799 - DNA, 556 bp, Homo sapiens
  misc_feature: GZ8MTXP02J0WQ2.51.86.H09.1.454.CMB.2.raw
  modified_base (383)..(383): a, c, t, g, unknown or other
  modified_base (387)..(387): a, c, t, g, unknown or other
  modified_base (392)..(392): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctactgaattggttcagcagaggccaggccaatctaccaagacgccttaaatttataaggtttctaaaccgggactcgtggggtccccagacagattcagcggcagtgggtcaggcactgatttcanactnataancgacgaggggtgaggctggaggtagttggtttaggggttttatacgttggctagtgacgtaaggtacacgacgtggcccgttagggacgtttcgggaccgtaacggggaccgaaaggtacggaaaatcgaaaacgacgtgtaggctgacactactctcgttctc

SEQ ID NO: 377800 - DNA, 614 bp, Homo sapiens
  misc_feature: GZ8MTXP02GDDVP.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggccctcctatatagtgatggaaacacctacttgaatttggttcagcagaggccaggccaatctccaaagaccgtaccttaaatttaataaggtttacctaaccggggactcgtccggggtccccagacagattcagcggcaggtggggcagggcactgatttcactactgaataatcgacgtaggggtggagcgtggaggtatttgggtttacgggtttttatactggacaagttgacgtaaggtaaccacgtaacgtcggtaccgtacgggggtaccgttccgggaacccgtaaaggggaacccgtaaaggggtacggtaaaacgtaccgaaaaacggtaccgtaggtcggacctacggaccaacgtac

SEQ ID NO: 377801 - DNA, 630 bp, Homo sapiens
  misc_feature: GZ8MTXP02G2TY1.51.86.H09.1.454.CMB.2.raw
  modified_base (255)..(255): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtgataggaaacnctattgaattggttcagcagagccaggccaatctaccaagaccgtaccttaaatttagtaaggtttccgtaaaccgggcttcgtcggggtacccagacagattcgagcggcaggtgggtcagggctactgaactttcactactagataacgtcgacggtaggggtggagtcgtaggaggtagttcggtttagggttttatacgttagctagtagacgtaaacggtacacgtacggtcggtccggtaggggtaccggttacgggaacccgtaaaggggtaacccgtaaggggttaacggaaaacgttaaccggaaaacggtaaacgttggaacggtccgttacggacctacctagttaccggtcgttacctttacg

SEQ ID NO: 377802 - DNA, 642 bp, Homo sapiens
  misc_feature: GZ8MTXP02IMN3H.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatcctcctgcaggtctagtcaaggcctctatatagtgatggaaactacctacttgaattggttcagcagagccaggccaatctaccaagaccgtaccttaaatttagtaacggtttacctaaccgggtactcgtcggggtacccagactagatcagcgacaggtcggtcgaggcacgttgactttcaactactagaataacgtcgacgaggggttaggagtcgtaggaggtattgggtttgggttttaattcgttgactagtcgacgtaaaggtacacgtacgtcgggtaccggttaggggtaccgggtttacgggaaccggtaaaacggggtacccggtaaaaggggttacggaaaaacgtaccgaaaacgggtaaacttgggtacggaacgtacggaccctaaccgtagttccgttacgttactttaccg

SEQ ID NO: 377803 - DNA, 643 bp, Homo sapiens
  misc_feature: GZ8MTXP02JTT9S.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatcctcctgcaggtctagtcaaggcctctatatagtgatacggaaactacctattgtaattggttcagcaggacggccaggccaatcctaccaagacgtaccttaagtttagtaacggtttaccgaaccggtactcggtacggggtacccagacagtatcgaggcggacaggttcgggcgaggctactgtactttcactacgtagtaattaacgtcgaacggagggggtgaggtctagggaggttgttaggttttagtttatacgtgacgtagtacgacgtaaacggacctacggtacggtcgggacggttaggggtacccgttaccgggaacgtaaacggggaacgtaaaggggtaacgaaaacgtaaccgtaaaacgtacgttggacgaaccgtacgaccgtaactagtttcgttccgttacgttaacccg

SEQ ID NO: 377804 - DNA, 601 bp, Homo sapiens
  misc_feature: GZ8MTXP02H2IG1.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatagaaacacctattgaattggttcagcagaggccaggccaatctaccaagaccgacttaatttagtaaggtttccaaaccgggtctcgtcgggtccagacagatcagcggcaggtgggcaggcacgtgtatttcactactagtaataacgtcggaacgaggggtaggaggtcgtaggaaggtagttggtttagggtttttacttaacgtggacgtagtagacgtaaaggtacacgtacgtcgggtacccgttggggaccgttcggaccggtaaaacgggaccgaaagggtacggaaaactaccgaaaacgtaacgtggtacggctagacctacctagttccgtacgtctttaccg

SEQ ID NO: 377805 - DNA, 560 bp, Homo sapiens
  misc_feature: GZ8MTXP02HCO4P.51.86.H09.1.454.CMB.2.raw
  modified_base (255)..(255): a, c, t, g, unknown or other
  modified_base (290)..(290): a, c, t, g, unknown or other
  modified_base (335)..(335): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacnctatgaattgttcagcagagccagcaatctcagcnctaatttatagtttcacggatcgtgggtccagacagatcagcggnaggtgggtcaggctacgtgtatttcatactgaatatcgagagggtggagcgtagaggtagttggtttgggtttaaattcgtggctagtggacgtaaacggtacaacgtacgtggccgttaggggacgttcgggaccgaaagggacccgaaagggtaggtaaaacacggaaaacgtacgtggttacgggaactacgaccgaaccgtaatacctgttcctttaaccg

SEQ ID NO: 377806 - DNA, 671 bp, Homo sapiens
  misc_feature: GZ8MTXP02ICM5Q.51.86.H09.1.454.CMB.2.raw
  modified_base (243)..(243): a, c, t, g, unknown or other
  modified_base (251)..(251): a, c, t, g, unknown or other
  modified_base (284)..(284): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaagcctctatatagtnatgaaacnctactgaattggttcagcagaggcaggcaatcncaagacgtactaatttaataaggtttactaaccgggtactacgtcggggtacccacgacgaacgtatacgagcggcgaggttcgggtcgaggctacgttagtactttacaactacgtagtaaagtaatacgacgtaagggggtaggaggacgttaggaagggtagtttgggtttaggggtttttaaaccttagttgagttagttagaacgtaaaggttaaccgaaacgtacgtacgggtcccggttaggggtaccgggtttacgggaacccgtaaaacgggggaaccggtaaaagggtaaaggttaaaacggaaaccgaaaaaccgtaaacgttcggtaggggccgtaggaccccgtacgaactttccggtttacgtttacgttacc

SEQ ID NO: 377807 - DNA, 577 bp, Homo sapiens
  misc_feature: GZ8MTXP02F23T6.51.86.H09.1.454.CMB.2.raw
  modified_base (556)..(556): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggctccatctcctgcaggtctagtcaaggcctctatatagtgatggaaacacctacttgaattggttcagcagagccaggccaatctaccaagactcctaatttataaggtttctaaccgggactcgtggggtcccagacagatccagcgcaggtgtcaggcatgtacttcactaactgaattaaagcgaacgtaggggtacgagggtctagaggtagttggtttgggtttaaatcgtagctaagttcgacgaaggttacacgtaccgtgggacgtacggggtacgttccggacgaaacggtaacgaacggtaaggaaactacgaaaacgtacgtagtacgctaagctaaaccgtnttacgtcgtctactacttccg

SEQ ID NO: 377808 - DNA, 612 bp, Homo sapiens
  misc_feature: GZ8MTXP02JWTTN.51.86.H09.1.454.CMB.2.raw
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctcaagacgcctaatttactaaggtttactaaccgggactcgtcggggtcccagacagattcagcggcaggtgggtcaggcactgatttcacactgactaatcgacgagggtggaggcgtggaggtattggtttaggggtttttattacgtgtctaagtcgacgtaaagggtaccacgtacgtcgggaccgttgggggtacgtttccgggacccgtaaacgggggaaaccccaaagggggttacggaaaaacgttaccgaaaaacggaacgttacgggtcggaacgttcggaccacccgtaattacccgttggtcctttaccg

SEQ ID NO: 377809 - DNA, 675 bp, Homo sapiens
  misc_feature: GZ8MTXP02HFBPI.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctgggcctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatcctaccaaagaccgtaccttaaatttaagtaacggttttaccaaacccggggtacttcgtacggggtaccccaagacagtacttccgaggcggacaggtgggtacagggcacttgactttacgactactagataaacgtcgacgtaggggtggaaggtcgtaggaggtagtttagggtttaggggttttaattacgtagtacgtagtcggtacgtaaacgggttacaacgtaccggtcgggtaccggttagggggtaccggttaccgggaaccggtaaaaggggaacccgtaaaaggggtacggaaaactaccggaaaaacgtacgtagggtacggtctacggaacctaccgtacttccgttacgttaccttaccgtacgtttccccg

SEQ ID NO: 377810 - DNA, 561 bp, Homo sapiens
  misc_feature: GZ8MTXP02GA3ZH.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctaccaagacgcctaaatttataaggtttctaaccgggactcgtggggtcccagacagattccagcgcaggtggtcaggcactgatttcacactgataatcgacaggggtgaggtctgaggtagttggtttgggtttattacgtgctagtgacgaagggttacacgtacgtcggtaccgtggggtaccgttcggaccgtaacggggaaccaagggtacggaaaatacgaaaacgaacgtggtacggctggaacacgatctgtctcactttcccg

SEQ ID NO: 377811 - DNA, 549 bp, Homo sapiens
  misc_feature: GZ8MTXP02GI1HN.51.86.H09.1.454.CMB.2.raw
  modified_base (346)..(346): a, c, t, g, unknown or other
  modified_base (375)..(375): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctttgactcagtctccactctccctgcccgtcacccttggacagccggcctccatctcctgcaggtctagtcaaggcctctatatagtgataggaaacacctacttgaattggttcagcagagccagccaatctacaagacacctaattataagttctaacggactcgtgggtccagacagtatcagcgnagtggtcagcactgattcacatgataaancgacgagggtggaggctagagggtattggtttacgggttttatcgtgctaattgacaaggtacagacgtggccgtaggggtacgttcggacgaaacggaacgaaagggtagaaaatacgaaaacgacgtggacgtcgtagaaccgactactacgtcgttacttacactttcccg

SEQ ID NO: 377812 - DNA, 571 bp, Homo sapiens
  misc_feature: GZ8MTXP02HVDHY.51.86.H09.1.454.CMB.2.raw
  modified_base (245)..(245): a, c, t, g, unknown or other
  modified_base (362)..(362): a, c, t, g, unknown or other
  modified_base (388)..(388): a, c, t, g, unknown or other
  modified_base (400)..(400): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaaggcctctatatagtnatacggaaactacctattgtaattggttcagcagaggccaggccaatctaccaagcgtaccttaatttacgtaaggtttctaaccgggctcgtggggtcccagacagtattcagcgnaggtggtcaggcatgtattcactacngaataatcgagnggggtgagctaggaggtatttggttaggttttatacgtgctagtcgacaaaggtacacgtacggtggccgttaggggacgttaccgggaccggaaacgggtaccgaaaggtacgaaaacgtacgaaaacgtaacgtggtacgcgtacgactacagttcgtacgtttcttac

SEQ ID NO: 377813 - DNA, 640 bp, Homo sapiens
  misc_feature: GZ8MTXP02FXVOG.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaaatctaccaaagacgcctaaatttataaggtttcaaccggactcgtggggtcccagacagattcagcgcagtggtcaggcactgatttcacactgataaatcgacgaggggtaggagcgtagaggagttggtttgggttttaattacgttgacgtagttaggacgtaaagggtacaacgaaccgttgggacccgttgggggtaaccgttccgggaacccgaaaagggggaacccgtaaaaggggttaacggaaaaacgttacgaaaaaccggtaaaccgttagggtacgggacgttacggaacccgtaaacctaacgttacccgtggtttacccttaacgtaacttttacccccg

SEQ ID NO: 377814 - DNA, 561 bp, Homo sapiens
  misc_feature: GZ8MTXP02G2SNV.51.86.H09.1.454.CMB.2.raw
  modified_base (383)..(383): a, c, t, g, unknown or other
  modified_base (433)..(433): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacacctacttgaattggttcagcagagcaggccaatctcaaagacgacctaaatttataaaggtttctaaccgggactcgtgggtccagacagatcagcgcagtggtcaggcactgatttcaacatgaataancgacgaagggtggagcgtagaggtaattggtttagggtttattaacgtgnaattgacaaaggtacaacacgtaggccgtagggacgttccggacgaaacgggaacgaaggtaagggaaaataacgaaaaggaaacgtagtagacgagaacaaccactacgtagttcttacactttccc

SEQ ID NO: 377815 - DNA, 584 bp, Homo sapiens
  misc_feature: GZ8MTXP02IC3PC.51.86.H09.1.454.CMB.2.raw
  modified_base (399)..(399): a, c, t, g, unknown or other
  modified_base (403)..(403): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctactgtaattggttcagcagaggccaggccaaatcctaccaagacgtacctaaattttataaggtttacaaaccggggtactcgtcggggtacccaggacagattcagcggcaggtgggtcagggcactgtatttcactacngtanaagtcgaagaggggtgaggctggaggtattggttgggttttaattcgtgactagtcgactaaaggtaccaacgtcgtagggccgttgggacggtttccggacgaaacggggaccgaaaggtacggtaaaacaacgaaaacgacgttggacggcgtcgacaccctagtcctcgttcttaccg

SEQ ID NO: 377816 - DNA, 616 bp, Homo sapiens
  misc_feature: GZ8MTXP02JNCLY.51.86.H09.1.454.CMB.2.raw
  modified_base (582)..(582): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgataggaaacacctacttgaattggttcagcagacggccaggccaatctaccaaagaccgtaccttaaattttaagtaacggtttaccgtaaaccgggtacttccgtacggggtaccccaaggacagtacttacgagcggacaggttcgggtcagggctacgtgactttcaactactagataatacgacgagggtaggagcgtaggaggtagttggtttagggttttaatcgtgctagtgacgtaaggtacacgtacgtcggccgttaggggtaccgtcgggaccgtaaacggggtaccgaaggtacggaaactaacggaaacgtaacgtggtacggngtacggacctaccgtagtcgttacgtctttaccg

SEQ ID NO: 377817 - DNA, 611 bp, Homo sapiens
  misc_feature: GZ8MTXP02IPV0R.51.86.H09.1.454.CMB.2.raw
  modified_base (253)..(253): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacncctacttgaattgttcagcagaggccaggccaatcaccaaagacgaccttaatttataacggtttctaaccgggacttcgtggggtcccaagacagattccagtcggctaggtcggtcagggcactgtactttcaaccgtactagaataaactcgacgaggggtggaggcgtaggaggtagttggtttagggtttattaacgtgactagtgtacgaaggtacacacgtcggacgtggggtaaccgttcggaccgtaaaggggaacccgtaaagggtacggtaaaactacggaaaaacgtaacgtggtacggctacggaacctaacccgtattccctggtacctttactactttccccg

SEQ ID NO: 377818 - DNA, 615 bp, Homo sapiens
  misc_feature: GZ8MTXP02I50GA.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagcccggcctccatcctcctgcaggtctagtcaaggcctcctatatagtgataggaaacacctatgaattggttcagcagaggccaggccaatctaccaagaccgtaccttaaatttaagtaaacggtttacctaaaccgggtacttccgtcggggtaccccaaggacagattcgagcggcaggtgggtcaggcatgatttcacactagaataatcgagaggggtggagcgtggaggtagttggtttagggttttaatacgttgctagtgacgaaaggtaccaacgtacgtcgggccgtaggggtaaccgttccgggaaccgtaaaacgggggaccgtaaaggggtaacgggaaaactacgaaaaacggtaacgtcggttacggaacgtacgacacctatccgttgtacctttac

SEQ ID NO: 377819 - DNA, 620 bp, Homo sapiens
  misc_feature: GZ8MTXP02JX5Q6.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacacctacttgaattggttcagcagaggccaggccaatcctaccaaagacgtaccttaaattttaagtaaacggttttccgtaaacccggggtactcggtcggggtaccccaaggaccagtattcgagcggactaggtgggtcagggctactgtatttcactactagaataacgtcgacgaggggtggaggcgtaggagggtagttggtttagggttttaattacgttgacgtagtagacgtaaaggttaccacgtacgtcggaccgtggggtaccggttacgggaccgtaaacggggaaccgaaagggtacggtaaaactacgaaaacgtacgtaggtcgaacgtcgacacctagtctcgtcttac

SEQ ID NO: 377820 - DNA, 544 bp, Homo sapiens
  misc_feature: GZ8MTXP02IXCFR.51.86.H09.1.454.CMB.2.raw
  modified_base (252)..(252): a, c, t, g, unknown or other
  modified_base (265)..(265): a, c, t, g, unknown or other
  modified_base (271)..(271): a, c, t, g, unknown or other
  modified_base (501)..(501): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctcatctcctgcaggtctagtcaagcctctatatagtgatgaaacnctatgaattgttnagcagngccagccatctacagacactaatttataaggtttcacggctcgtgggtccagacagtatcgagcggcaggtcgggtcagggctactgtactttcgaactactagataaagtccgaagaggggtggagcgtaggaggtagttggttaggttttatacgtgctagtgacgtaagtacacgtacgtcggacgtgggtacgtcggaacgtaacgggacgtaaaggtagtaaaanacgaaaacgacgtggtagctgaccaccgatcgtcgtacttacg

SEQ ID NO: 377821 - DNA, 604 bp, Homo sapiens
  misc_feature: GZ8MTXP02HRML6.51.86.H09.1.454.CMB.2.raw
  modified_base (370)..(370): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgataggaaacacctacttgattggttcagcagagcaggccaatctacaagcgactaattataaggttctaaccggatcgtggggtccagacagattccagcggcaggtggtcagggcatgtattcanactgatagtcgacgtaggggtggaggtcgtaggaggtaagtttgggtttacggggttttattacgtggtactagttggacgtaacgggtaccacgacgtcgggtaccgttacgggggtaccggttccggacccggtaaacggggaacccgtaaagggtaacgggaaataaccgaaaacggtaacgtggtcgggactcgaacctaaccgtcttcgtcgttccttactaccgttcc

SEQ ID NO: 377822 - DNA, 644 bp, Homo sapiens
  misc_feature: GZ8MTXP02HYCBY.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctccatctcctgcaggtctagtcaaggcctcctatatagtgatggaaacacctacttgaattggttcagcagagccaggccaatctaccaagacgaccttaaatttataaggtttactaaccgggactcgtcggggtcccagaccagacttccagcggcaggtgggtcagggcactgactttcaactactagaataaatcgaacgaggggtggaggtcttaggagggtaatttgggtttaggggtttttatacgttaggtctaagtgacgtaaagggtacaccgtacgtgggtcccgtaggggtaccgttccgggaaccgtaaacggggaaccgtaaaaggggtacggaaaaacgtaccgaaaaacggtaaaccgttcgggtacggccgttaacggcctaaaccgtacttaccgttagttcctttacgtactttcccccg

SEQ ID NO: 377823 - DNA, 646 bp, Homo sapiens
  misc_feature: GZ8MTXP02GBDGM.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacacctacttgaattggttacagcagaggccaggccaatctaccaagacgtacctaaatttacgtaaggtttacctaaaccgggtacttacgtcggggtacccaggacagtacttcgagcggcaggtgggtcgaggcacgtgactttcactactagaataacgtcgaacgaggggtggaggcgtggaaggtagttaggtttagggttttattacgtgactagtagaccgtaaaggtaccacgtacgtcgggtccgtaggggtaccgttacgggaccgtaaaacggggaaacccgaaaggggtaacggtaaaacgtaaccggtaaaaccgtaaaccgttggtacgggaaccgtacggtaccaacccgtaacttcgttacggttcctttaacccg

SEQ ID NO: 377824 - DNA, 628 bp, Homo sapiens
  misc_feature: GZ8MTXP02F89G1.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaaatctaccaaagaccgtaccttaaattttagtaaaggtttacctaaaccgggtactcgtcggggtcccagacagacttcagcggcaggtgggtcaggcactgtatttcactactgaataatcgacgaggggtgagctaggaggtattggtttgggttttattacgtgactagtcgacgtaaggtacacgtacgtcggccgtggggtaaccggttcgggaccgaaacggggtaccgtaaaaggggtacgggtaaaaactaccggaaaacggtaaacgttcgggtacggtaaccgttacgggacctaacccgtaagtttaccgttcgttacctttaaccg

SEQ ID NO: 377825 - DNA, 592 bp, Homo sapiens
  misc_feature: GZ8MTXP02FRFVD.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatcgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagcgtaccttaaatttataaaggtttccaaaccggggacttcgtggggtcccaggactagattcgagcggcaggtgggtcaggcacgtgatttacacactgataaatcgaacgaggggtggagctggaggtattggtttggtttatactgcagttgactaaaggtaccacgtacgtgggtcctggggtacgttccgggaaccgtaaacgggggaccctaaaggggtaggaaaacgttcgaaaaacggaaccgttggtagggcctacggacctacccatttcgtacgttctttaccg

SEQ ID NO: 377826 - DNA, 634 bp, Homo sapiens
  misc_feature: GZ8MTXP02GN28R.51.86.H09.1.454.CMB.2.raw
  modified_base (254)..(254): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatggaaacncctacttgaattggttcagcagagccaggccaatctccaagacaccttaaatttataaggtttctaaaccgggctcgtggggtcccagacagattcagcgcagtgggtcagggcactgatttcacactagataatcgacgaggggtcggaggcgtggaggtagttggtttggggttttattacgtgctagtcgacgtaaggtaccacgtacgtcgggtccgtaggggtaccggtttaccgggaccgtaaaacgggggaacccgtaaaggggtaacgggtaaaacgtaccggtaaaaccggtaaaccgttcgggtaacggggtaaccttacggggaccctaccccggtaattacccggttcggtttacccgttttaacccg

SEQ ID NO: 377827 - DNA, 583 bp, Homo sapiens
  misc_feature: GZ8MTXP02GP1W0.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactacttgaattggttcagcagaggccaggccaaatctccaagacgacctaaatttataaggtttactaaccgggactcgtggggtcccagacagattcagcggcagtgggtcaggcactgatttcacactagataaatcgacgaggggtggagctagaggtattgttgggttttatacgtgcatgacgaaggtacacacgtggtccgtggggtaccgttcgggaccgaaaaggggacccgaaagggttacggaaaacgttaacgaaaaccggtaaacgtggttacggaacgttacggaccaaccctattaccgtacgttcctttaccg

SEQ ID NO: 377828 - DNA, 601 bp, Homo sapiens
  misc_feature: GZ8MTXP02JXEZ9.51.86.H09.1.454.CMB.2.raw
  modified_base (377)..(377): a, c, t, g, unknown or other
  modified_base (427)..(427): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatgaaacacctactgtaattggttcagcagaggccaggccaatctaccaagacgtacctaaatttacgtaaaggtttctaaccgggactcgtcggggtacccagacagatcgagcggnaggtggtcaggactatgatttcactactgaatagcgacgaggggtgaggngtaggaggtagttggtttggggttttattacgtgacgtagttggacgtaaaggtacacgtacgtcgggaccgtaggggtacccggttacgggacccggtaaaaggggacccgtaaagggttaacggaaactaaccggtaaaacgaacgtcggtacggcctacggaccaccgtag

SEQ ID NO: 377829 - DNA, 606 bp, Homo sapiens
  misc_feature: GZ8MTXP02IUZM0.51.86.H09.1.454.CMB.2.raw
  modified_base (248)..(248): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcaccttggacagccgcctcatctcctgcaggtctagtcaagcctctatatagtgatgaaacncctattgaattggttcagcagagccaggccaatcacaagactactaaatttagtaaggtttcaaccggtctcgtcgggtacccaagacagtatccgagcgacaggtcgggtacagggcctacgtgtaactttccaactacgtagtaaactaacgtcggaacgagggggtaggaggtcgtaggaaggtagtttgggtttaggtttatacgtgactagtacgtaacaaggtacaacgtacgtggccgtaggggtacgttacggaaccgtaaagggaaaccgtaagggtagaaaactacgaaaaccgtagttggacgtcgtacgaaccgtaactagttctcgttcttacctactttccccg

SEQ ID NO: 377830 - DNA, 628 bp, Homo sapiens
  misc_feature: GZ8MTXP02ISH61.51.86.H09.1.454.CMB.2.raw
  modified_base (255)..(255): a, c, t, g, unknown or other
  modified_base (277)..(277): a, c, t, g, unknown or other
  modified_base (304)..(304): a, c, t, g, unknown or other
  modified_base (320)..(320): a, c, t, g, unknown or other
  modified_base (343)..(343): a, c, t, g, unknown or other
  modified_base (392)..(392): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctcctgcccgtcacccttggacagccgcctccatctcctgcaggtctagtcaaggcctctatatagtgataggaaacncctacttgaattggtcagcagngccagcaatctacaagacgctaattanagtttcaacggctcgngggtccagacagattcgagcggnaggtggtcagggctacgtgaatttcaactactagataaactcggaacgnggggtacggagtcgtaggaaggtagttggtttagggtttatacgtgactagtagacgtaaacgtacgacacgttcgggaccgtacgggaccggtttacccgggaaccggtaaacgggaacccggtaaaagggtaaccgggtaaaacgttaaccggaaaaaccggtaaccgttagggtacggtaaccgttaccgaaccggaaccttaacgtttaccgttcggttaccctttaacccg

SEQ ID NO: 377831 - DNA, 781 bp, Homo sapiens
  misc_feature: GZ8MTXP02HU45Z.51.86.H09.1.454.CMB.2.raw
  modified_base (284)..(284): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcaccttggacagccggcctccactcctcgcgagtcgtagtacgaacggaccgtccctatatagtgataggaacgaacctacttagtataggtttcgtanacgagaggccgacggccgaactacttcaacgaaacggtccttaactttaaatttaaaaggtttaccgttaaaccgggaaccgtacgttcggggttacccgacgaacgaagatactacgacggcgacgtaggggtcgaggacgtccgtagtacgttacctacaacctggtaaataaacttaacggaccgaagggggttacgggaacggggacgtgtaagggggaaagtttggttttaccggggggtttttaaagtttttaaccgagtacgtaacgttacggtaacggtaaacggtaacgtaccgtaccgttacggggtacccggttacggggtaacccgggtttacgggtaacccggaaacggggtaaaaccggtaaaagggttaaacggaaaacgtaaaccgtaaaacggtaaacggttacggtacggtacgtaccgaaccgtaaccgtactttccggttacgttacctttaccgtaaccgtttacccgttaccccg

SEQ ID NO: 377832 - DNA, 629 bp, Homo sapiens
  misc_feature: GZ8MTXP02FT129.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctaccaaagacgcctaaatttataaggtttctaaccggatcgtggggtcccagacagtattcagcggctaggtcgggtcaacggctactggtactttcactactgaattaatcggaacgaggggtggaggtcgtaggaggtagttgggtttgggttttaattacgttgtacgagttggacctaaagggttaccaacgtacgtcgggacccgtagggggtaccgttacggggacccggtaaagggggaacccgaaaaggggttacggaaaacgtaaccgaaaacgtaacgtcggtaggcgtacggaaccgtaccagttaccgttgtcgttaccactttcccg

SEQ ID NO: 377833 - DNA, 620 bp, Homo sapiens
  misc_feature: GZ8MTXP02FUWC5.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgctccatctcctgcaggtctagtcaaggcctcctatatagtgatggaaacacctacttgaattggttcagcagaggccaggccaatctaccaagacgtccttaaatttataaggtttactaaccgggacttcgtggggtccccagacagtattcgagcggacaggtgggtcaggctacgtgtatttcacgtactgaataatcgacgaggggtgaggctaggaggtagttaggtttgggttttaattacgtgtacgtatggaccaaaggtaccaacacgtcggtccgtgggtaccggttcggaacccgaaacggggaaccgtaagggtaaggtaaaacgttacgaaaaaccggtaaacgtggttacgggaaccgttcggaacccgaaccgtaacttaccgttacgtttcctttacccg

SEQ ID NO: 377834 - DNA, 545 bp, Homo sapiens
  misc_feature: GZ8MTXP02JBI5G.51.86.H09.1.454.CMB.2.raw
  modified_base (386)..(386): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctcaagacgcctaatttataaggtttctaaaccggctctggggtcccagacagattcagcggcagtgggtcaggcactgatttcacactgataancgacgagggtgagctgaggtatggttgggttttattacgtgactatgacaaaggtacacgactgggactggggtacgttcggaccgaaacgggaccgaaagggtacgggaaatacgaaaacgaactggtacggaactcggactaccatctcgtactttc

SEQ ID NO: 377835 - DNA, 550 bp, Homo sapiens
  misc_feature: GZ8MTXP02JBRWZ.51.86.H09.1.454.CMB.2.raw
  modified_base (266)..(266): a, c, t, g, unknown or other
  modified_base (418)..(418): a, c, t, g, unknown or other
tcagcgatcgtatacacgaccggtgctcgatttagtgctatagacttgggtttgggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctacttgaattggttcagcagaggccaggccaatctcaagacgcctaatttataaggtttctaaccgggactctggggtcccagacagattcagcggcaggtgggtcaggcactgatttcacactgataatcgacagggtggagctgaggnttggttgggttttatacgtgcaagtgacaaggtacacacgtggccgtggggacgtttcggaccgaaacggggaccgaaaggtacggaaaatacgaaaacggtaactaggtacggacctaggcctaaccgtag

SEQ ID NO: 377836 - DNA, 682 bp, Homo sapiens
  misc_feature: GZ8MTXP02F3KZC.51.86.H09.1.454.CMB.2.raw
  modified_base (258)..(258): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtgggatgttgtgctgactcagtctccactctccctgccccgtcacccttggacagcccggcctccatctcctgcaggtctagtcaaggcctcctatatagtgataggaaacncctattgaattggttcagcagaggccaggaccaatcctaccaaagaccgtacctaaattttataaaggtttcctaaaccgggactacgtcggggtcccaagacacgtatcgaagcggacgagtgggtcgacgcacgtagtactttacactactgaattaatacgaacgaggggtacggaggacgtggaaggtagttagggtttagggtttttattaacgtgtacgagttcggaacgaaaggtaacctaaccaacgtcggggtaaccgtcgggggtaaccggtttcccgggaaccgggtaaaacggggtaaccccgtaaaaagggggttaggaaaaaccgttaaccgaaaaacgggtaaaaccgttcggggttaaggaacgtacgaccgaaaccccgtaatttccgttacggttctttaaccccg

SEQ ID NO: 377837 - DNA, 574 bp, Homo sapiens
  misc_feature: GZ8MTXP02IFDJE.51.86.H09.1.454.CMB.2.raw
  modified_base (291)..(291): a, c, t, g, unknown or other
  modified_base (407)..(407): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctcatctcctgcaggtctagtcaaggcctctatatagtgatggaaacactacttgaattggttcagcagaggcagccaatctcaanacgtacctaatttaataggtttactaaccggatcgtggggtcccagaccagattcagcggcaggtgggtcagggcactgtatttcaactactgtaataaatcgacgagggtgaggngtgagtagtgttggtttatactgatatgataaggtacacacgtggtacgtggggaccgttcggaccgaaacgggaccgaaagggtagaaaacgtacgtaaaacgaaaccgttggtaacggtcgtaacggaccttaaccgaacgtttacctacggtttctttaacccg

SEQ ID NO: 377838 - DNA, 567 bp, Homo sapiens
  misc_feature: GZ8MTXP02JHG9P.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctactgaattggttcagcagaggccaggccaatctaccaagacgcctaatttataaggtttctaaccgggtactctggggtcccagacagattcagcggcaggtgggtcaggcacgtgattcacactagataatcgacgagggtgagctgagtatgttgggtttatacgtgtcagtgacgtaaggtacagacgtggaccgtgggaaccgttcgggacccgaacgggaccgtaagggtaaggaaaacgtacgaaaaccgtaacgtggtaggtcctacggtaccaacccgttagtcgttacgttacgttacg

SEQ ID NO: 377839 - DNA, 590 bp, Homo sapiens
  misc_feature: GZ8MTXP02FG56I.51.86.H09.1.454.CMB.2.raw
  modified_base (293)..(293): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattgggttcagcagaggccaggccaatcnccaagcgcctaaatttataaggtttcaaaccgggctcgtggggtcccagacagattcagcgcaggtgggtcaggcactgtatttcacactagaataactcgacgaggggtggagctaggaggtattggtttgggttttaatacgtgcagtgacgaaggtaccacgtacgtcggggtccgtaggggtaccggttccgggaaccgtaaacggggaaacccgaaagggttaaggaaaacgtacgaaaaaccggaacgtaggtcgggaacttcggaccacccgacttctacgtctttaccg

SEQ ID NO: 377840 - DNA, 625 bp, Homo sapiens
  misc_feature: GZ8MTXP02FSV3Q.51.86.H09.1.454.CMB.2.raw
  modified_base (264)..(264): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaagcctctatatagtgatgaaacncctacttgaattggttcagcagaggccaggccaatcctacaagactaccttaaatttagtaaggtttcaaaccgggactcgtcggggtacccagacagtattcgagcggcaggtgggtaccaggcacgtgtatttacactacgtagaaataacgtcgaacgagggggttaggaggtacgtaggtaaagggtagtttggggttttagggtttttacgttacgttgggactagttagacgtaaacggtaacacgtacgttgggacccgttaggggacgttaccgggacgaaacggggtaacaaggggttaacgaaaacgttacgaaaaacggtactagggtacgaccgtacggaccactaacg

SEQ ID NO: 377841 - DNA, 575 bp, Homo sapiens
  misc_feature: GZ8MTXP02I1KPX.51.86.H09.1.454.CMB.2.raw
  modified_base (268)..(268): a, c, t, g, unknown or other
  modified_base (300)..(300): a, c, t, g, unknown or other
  modified_base (332)..(332): a, c, t, g, unknown or other
  modified_base (415)..(415): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacncctattgaattggttcagcagagcagcaatcncaagactactaatttataaggtttcaaccggntcgtcgggtacccagacagattcagcggcaggtgggtcaggcactgattcacactagaataagtcgacgtaggggtggacggngtaggaaggtagttgggtttagggtttttatacgttgactagtagacgaaggtacacgtacgtcggtccgtacggggtacgttcggaccgaaacggggaccgaaagggtacgaaaagtacgaaaacggtaacgtggtacggactacggacgtaaccgtag

SEQ ID NO: 377842 - DNA, 579 bp, Homo sapiens
  misc_feature: GZ8MTXP02FEUB4.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggctccatctcctgcaggtctagtcaaggcctctatatagtgatggaacacctacttgaattggttcagcagaggccaggccaatctaccaaagacgtaccttaaatttagtaaggtttactaaaccggggacttcgtcggggtccagacagattcgagcggcagtgggtcagggcacgtgatttcactactgaataatcgacgagggtggaggcgtgaggtattggtttgggttttattacgtgcagtgacgaaggtacacgaaacgtggaccgtgggaccgttcggaccgaaagggaaccgaaagggtacgaaaacgtacgaaaaccgtaaacgtcgtacggctacggaccaaccacgttctcgttctttaccg

SEQ ID NO: 377843 - DNA, 634 bp, Homo sapiens
  misc_feature: GZ8MTXP02JITBK.51.86.H09.1.454.CMB.2.raw
  modified_base (260)..(260): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtctccactctccctgcccgtcacccttggacagcccggcctccatcctcctgcaggtctagtcaagcctctatatagtnatggaaacacctactgaattggttcagtcagacggccaggccaatctaccaagacgtaccttaaatttagtaaggtttcctaaccgggcttcgtaccggggtcccagacagtacttcgagcggctagggtcgggtcagggactacgtgtacttcactactagataagtcgacgaggggtggacggtgtgagggtagtttgggtttaggtttttatacgtggtactagtgacgaacgggtacacgtaacgtggtacccggttcggggtaacgttaccggggaacccgtaaaggggaacccggtaaagggttaacggaaacgtaaacgaaaaccggtaaacgtgggttacggtacgtcgtaaccggacctttacgg

SEQ ID NO: 377844 - DNA, 583 bp, Homo sapiens
  misc_feature: GZ8MTXP02GC7B2.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatgaaacactacttgaattggttcagcagagccaggccaatctacaagacgactaaatttataaaggttctaacgggctcgtcggggtcccagacagatcagcgcagtgggtcagtcactgattcacatgataatcgacgtagggtggagcgtaggaagggtagttaggtttaggggtttttacttaagtcggtactaagttgacgtaaaaggtacaactacgtggccggtaggggtacgttacggacccgaaaagggaacccgtaaaggtacgggtaaaactaacgaaaacggaacgttacgaggtactacggaccaacgtacg

SEQ ID NO: 377845 - DNA, 618 bp, Homo sapiens
  misc_feature: GZ8MTXP02JVOWA.51.86.H09.1.454.CMB.2.raw
  modified_base (260)..(260): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccgttggacagcccggcctccatcctcctgcaggtctagtcaaggcctctatatagtgataggaaacnccttatgtaattggtcagcagaggccagccatctaccaagactactaatttagtaacggtttcgaaccgggtactcgtacggggtacccaggacagtacttacgagtcggcgtaggtgggtccaggctacgtgtactttcgactactagaattaagccggaaggtagggtagggaggtagtaggtagggttagtttcgggtttagggtttttaaactcgtaggtactagtagaccgtaagtaacgaccgtacgtcggtccgtaggggtaccgtacgggacccgaaagggaacgtaagggtacggaaactaacgaaaacgtcgtgacgcgacgtacacgtatcgttacgtactttaccg

SEQ ID NO: 377846 - DNA, 574 bp, Homo sapiens
  misc_feature: GZ8MTXP02JKPHM.51.86.H09.1.454.CMB.2.raw
  modified_base (395)..(395): a, c, t, g, unknown or other
  modified_base (426)..(426): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggtttcagtcagaggccaggccaatcctacaagacgcctaatttataaggtttctaaccgggactctcggggtcccagacagattcagcggcaggtggtcagggcactgacttcanactgataatcgacgagggtggagctgaggtnttgttgggttttatacgttgactagtgacgtaaggtacagtaacgtggacccgttggggaccgtttcgggaccgaaagggaaccgaaaggttacggggaaataccgaaaacggttaaacggacggtacggacgtacgacctacgtacg

SEQ ID NO: 377847 - DNA, 612 bp, Homo sapiens
  misc_feature: GZ8MTXP02H64GL.51.86.H09.1.454.CMB.2.raw
  modified_base (258)..(258): a, c, t, g, unknown or other
  modified_base (423)..(423): a, c, t, g, unknown or other
tcagcgatcgtatacacgaccggtgctcgatttagtgctatagacttgggtttgggactgatcaggactcctcagttcaccttctcacaatgaggctccctgctcagctcctggggctgctaatgctctgggtcccaggttccagtggggatgttgtgctgactcagtctcccactctccctgccccgtcacccttggacagcccggcctccatcctcctgcaggtctagtcaaggcctctatatagtgatggaaacncctattgaattggttcagcagaggccaggcaatcctacaagaccgtacttaaatttaagtaaggtttctaaaccgggctcgtcggggtacccagacagtatcgagcggacaggtgggtcaggcacgtgtacttcgatactgataagtcgacgaggggtagacggngtaggaggtagttggtttagggtttattacgttgactagttaggaccgtaaagggtcaacgacgtcggacgttaggggacgttaccggacgtaaaacgggaccgtaaagggtaagaaaacgtacggtaaaacgtacgttaggtcggtaactcggaactaccggtaattccgtacggtttacctttaccg

SEQ ID NO: 377848 - DNA, 603 bp, Homo sapiens
  misc_feature: GZ8MTXP02J2VWO.51.86.H09.1.454.CMB.2.raw
  modified_base (254)..(254): a, c, t, g, unknown or other
  modified_base (580)..(580): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccaggtggggatgttgtgctgactcagtctccactctccctgcccgtcacccttggacagccggcctccatctcctgcaggtctagtcaaggcctctatatagtgataggaaacncctacttgaattggttcagcagagccaggccatctcaagcgctaattataaggttcaaccggatcgtcggggtcccagacagtatccgagcggcaggttcggcagggcacgtgactttcgactactagataacgtcgacgaggggtggaggtctagggaggtagtttgggtttagggtttttatacgtggactagtacggacgaaaggttaccacgtacgtcggggtaccgttacgggggtacggttccgggaccgtaaaagggggaccctaaaggggtacggaaaactacgaaaacgtacgttcgacggacctaggcctaacctntccgtgtccttacgactttcccg

SEQ ID NO: 377849 - DNA, 591 bp, Homo sapiens
  misc_feature: GZ8MTXP02IM2PA.51.86.H09.1.454.CMB.2.raw
  modified_base (383)..(383): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcggtctccactctccctgcccgtcacccttggacagccgcctccatctcctgcaggtctagtcaaggcctctatatagtgataggaaacactacttgaattggttcagcagagccaggaccaatcctacaaagaccgtaccttaaatttattaaacggtttcctaaaaccgggtcttcgtcggggtacccagaacagtacttcgagcgcaggtggtcngggcaactgtatttcgactactgaataatcgagaggggtggaaggctaggagtagttggtttaggtttattactgactagttacgacgtaaggtacacgtacgtcgggccgtgggtacggttccggaacgtaacgggaaccgtaaagggtagaaacgtaacgaaacgtacgtagtggactcgacgaacctagtcgtctcttactaccg

SEQ ID NO: 377850 - DNA, 516 bp, Homo sapiens
  misc_feature: GZ8MTXP02FIHS7.51.86.H09.1.454.CMB.2.raw
  modified_base (434)..(434): a, c, t, g, unknown or other
  modified_base (504)..(504): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctccagacgcctaatttataaggtttctaaccgggactctggggtcccagacagattccagcgcagtgggcaggcactgatttcacactgataaatcgacagggtgaggctgagatgttgggttttatactgcatgacaggtacanacgtggccgtgggacgtcggaccaagggaccgaaggtgaaatacaaacgaactgtcggactgcgacatcngtactctatccg

SEQ ID NO: 377851 - DNA, 690 bp, Homo sapiens
  misc_feature: GZ8MTXP02IAPRC.51.86.H09.1.454.CMB.2.raw
  modified_base (235)..(235): a, c, t, g, unknown or other
  modified_base (267)..(267): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctcctgcccgtcaccctggacagccgcctccatctcctgcaggtctagtacaacgcctctanatagtgatacgaaacactatagtattggttanagacgagacggcagaccaatccacaaagaccacttaaattaagtaggttaccgaaccggtatcggtacgggaccagacagtactccgagcgcaggtggtacacggtctacgtgtactttacactacgtataaataacgtacgaaggtaggggtaggaggcgtaggaaggttagtttgggttttagggtttactacgtaggtagtaagtacggtaacgtaaacggttaccgaacgttacggtaccgggtccggttacgggggtaccggtttaccgggaaaccggtaaaacgggggaaaacccggtaaaaggggttaaaacggaaacgtaaaaccgtaaaacggtaaacgtttgggtaccgggacttacggaacccgtaaactaacgttaccgttacggtttccctttactaaaccgttcccccg

SEQ ID NO: 377852 - DNA, 597 bp, Homo sapiens
  misc_feature: GZ8MTXP02IFEEG.51.86.H09.1.454.CMB.2.raw
  modified_base (257)..(257): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacagccggcctccatctcctgcaggtctagtcaaggtcctctatatagtgatggaaacnctatgaattggttcagcagacgcaggccaatctacaagacaccttaaatttagtaaggtttcaaaccgggactcgtacggggtacccaggacagtattcgagcggcagggtcggtcaggcacttgtactttcatactagactaatcgacggaagggtggaaggctaggaggtagttggtttaggtttattacgtgactagtgacgtaaggtacaccgtagtcggtccggtagggtaccggttacgacccggaaaagggtaaccgaaaggggttaacggaaaacgtaacgaaacggaacttggtacggcgtaggacctactactccgttagtccttaaccg

SEQ ID NO: 377853 - DNA, 546 bp, Homo sapiens
  misc_feature: GZ8MTXP02IXYBE.51.86.H09.1.454.CMB.2.raw
  modified_base (430)..(430): a, c, t, g, unknown or other
tcagcgatcgtatacacgaccggtgctcgatttagtgctatagacttgggtttggggatcaggactcctcagttcaccttctcacaatgaggctccctgctcagctcctggggctgctaatgctctgggtcccaggttccagtgggatgttgtgctgactcagtctccactctccctgcccgtcacccttggacagccgcctccatctcctgcaggtctagtcaaggcctcctatatagtgatggaaacacctacttgaattggttcagcagaggccaggccaatctccaagacgcctaaatttataaggtttctaaccggactcgtcggggtcccagacagattccagcgcagtgggtcaggcactgatttcactactgataaatcgacaggggtgaggctgaggtattggtttgggtttatacgttgntagttgacaaggtacacacgtggcctggggacgttccggacgaaagggacctaaggtaggaaaatacgaaaacgaactgtacggctagaacaccgatctagtccttacacttcccg

SEQ ID NO: 377854 - DNA, 644 bp, Homo sapiens
  misc_feature: GZ8MTXP02GRSCS.51.86.H09.1.454.CMB.2.raw
  modified_base (254)..(254): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctctatatagtgatggaaacnctacttgaattggttcagcagaggccaggccaatctaccaaagacgtaccttaaatttactaaacggtttcctaaaccggggacttccgtacgggggtccccaggtaaccaggtactttccgaaggccggactagggttcggggtccaaggggtccaacgttggtaacttttccaaactaccttagtaataaaacgtcgaacgtaggggtacgggaggtcgtaggaggtacttggtttagggtttatacgtgactagtgacgtaaggtacacgtacgtcggaccgttggggaaccgttcgggaccgtaaaaggggacccgtaaagggtacggaaaactaccgaaaacgtacgttaggtcggaactcggacaccgtatccttgtactttcg

SEQ ID NO: 377855 - DNA, 670 bp, Homo sapiens
  misc_feature: GZ8MTXP02GEF12.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctactatatagtgataggaaacaccttacttgtaattggttcagcagacggccaggaccaatcctaccaaagaccgtaccttaaattttaagttaaacggtttaccgtaaaccgggtacttccggtacggggtaccccaaggaacctagtacttccgacggccggacgtagggtcggggtaccgaagggtccaacgttggtactttaccaacctacgtagtaaacttaaacgtcgaacggtagggggtaggacggtgtaggagggttagtttaggggttttagggtttacttacgtaggtactagtacgaacgtaagggtacacgtacgtcggtacgtcggggtacgtacggacgaaagggtaacgaagggtacgaaactacgtaaaacgagtcggtacgactacgaaccacgtattcgtcgtacttctacgtttcccg

SEQ ID NO: 377856 - DNA, 540 bp, Homo sapiens
  misc_feature: GZ8MTXP02FFPFW.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggtttcagcagaggccaggccaatctcaagacgcctaaatttataaaggtttcaacgggactctcggggtcccagacagatcagcggcagtgggtcaggcactgatttcaacactagataatcgacgaggggtggaggctgaggtatggtttgggttttattacgtgcatgacaaaggtacaacgactggcctggggacgttcggaccgaaagggaccaagggtaggaaatacgaaaacgaacgtggtaggctgacacaac

SEQ ID NO: 377857 - DNA, 602 bp, Homo sapiens
  misc_feature: GZ8MTXP02I64XJ.51.86.H09.1.454.CMB.2.raw
  modified_base (293)..(293): a, c, t, g, unknown or other
  modified_base (349)..(349): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagccgcctccatctcctgcaggtctagtcaagcctctatatagtgataggaacactatgaattggttcagcagagccaggccatctacagacncttaattataacgttctaaccgggctcgtacggggtcccagacagactcagccggnaggtcgggtcagggcacgtgtactttcgactactagaataacgtcggaacggagggggtacggaggtctagggtaagggtagttagggttttaggggttttaattacggtgtacgtagttagacgtaaacggtaacacgtacgtcggtaccgtggggtacggttcggaccggaaacgggacgaaagggtacgaaaacgtacgaaaacggtaactgggtagaacgtcggacctaccattcgtctttacgttacc

SEQ ID NO: 377858 - DNA, 602 bp, Homo sapiens
  misc_feature: GZ8MTXP02JTP5S.51.86.H09.1.454.CMB.2.raw
  modified_base (445)..(445): a, c, t, g, unknown or other
tcagcgatcgtatacacgaccggtgctcgatttagtgctatagacttggggtttggggactgatcaggactcctcagttcaccttctcacaatgaggctccctgctcagctcctggggctgctaatgctctgggtcccaggttccagtggggatgttgtgctgactcagtctccactctcccctgcccgtcacccgttggacagccggcctccatctcctgcaggtctagtcaggcctctatatagtgataggaacactacttgaattggttacagcagagccagccatctacaagccgtactaatttaataaggtttcgtaaaccgggtctcgtagggggtccccaagtaccagtattcgcgcggcgagttggggtcaagggtcaccgttgtaactttcaactactagaataaagtcgacgagggtagggagtacgtgaaggtntaggttttagggttttaattacgttgacagtgacgaaggtacacgtacgtcggccgtaggggtacgggttccgaaccggaaacgggaccgtaaggtaaggtaaaactaacgaaaacgtaacgtggtcggaactcgactacactcttacgtctttacc

SEQ ID NO: 377859 - DNA, 553 bp, Homo sapiens
  misc_feature: GZ8MTXP02F5JIQ.51.86.H09.1.454.CMB.2.raw
  modified_base (432)..(432): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacgccttaaatttataaggtttctaaaccgggctcgtggggtcccagacagatcagcgcaggtgggtcaggcactgatttcacactgaataatcgacgaggggtgagctagaggtatgttgggtttatgtgctangacaaggtacacgtacgtggaccgtggggaaccttcgggacaaacggggacccgtaaagggtacggaaaatacgaaaaccgtaacgtggtaggaactgacacgtatcctggttactttacg

SEQ ID NO: 377860 - DNA, 597 bp, Homo sapiens
  misc_feature: GZ8MTXP02JEOVX.51.86.H09.1.454.CMB.2.raw
  modified_base (197)..(197): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacngccggcctccatctcctgcaggtctagtcaacggcctcctatatagtgataggaaacacctacttgaattggttcagcagaggccaggccaatctaccaaagacgaccttaatttagtaaggtttcgaacgggtactcgtcggggtacccagacaggtattccgaggcggcaggtcgggtacacgggctactgtactttccactactagaataaacgtcgaacgtaagggggtggaacggtcgtaggagggtagtttgggtttagggttttatacgtgactagtagacgtaaggtacacgtacgtcggccgtggggtacgttcggacgaaaggggacaaagggtagaaactacgaaaacgacgtggtacgctagcaccgtatcgtgtcttcactttcccg

SEQ ID NO: 377861 - DNA, 542 bp, Homo sapiens
  misc_feature: GZ8MTXP02ITKPW.51.86.H09.1.454.CMB.2.raw
  modified_base (254)..(254): a, c, t, g, unknown or other
  modified_base (345)..(345): a, c, t, g, unknown or other
  modified_base (367)..(367): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaagcctctatatagtgatggaaacnctactgaattgttcagcagagccagcaatctcaagacgtactaatttataaggtttctaaacgggctcgtgggtcccagacagatcagcgnagtgggtcaggcatgtattcanactagataagcgacgagggtaggagactggaggtagttggtttagggttttaattcgttagctatgacgtaagtacacgacgtggccgtgggaccgttcggacgaaagggaccaaaggtagaaaactacgaaaacgacgtgtacggtctacgacacctagtccttagtaccttac

SEQ ID NO: 377862 - DNA, 630 bp, Homo sapiens
  misc_feature: GZ8MTXP02FY7MH.51.86.H09.1.454.CMB.2.raw
  modified_base (362)..(362): a, c, t, g, unknown or other
  modified_base (371)..(371): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtctccactctccctgcccgtcacccttggacacgccggcctccatctcctgcaggtctagtcaacggcctctatatagtgatgaaacacctacttgaattggttcagcagagcaggccatctacaagacgacctaatttagttaaggttcgtaacgggtactcgtcggggtacccagacanattcagcgnaggtgggtcaggcactgtattcacactagaataatacgacgaggggtagggaggacgtagaagggttagttggttttaggggtttttaattaccgttaggtactagttagacgtaaagggtacacgtaacgtcggtaccgtacggggtaacggttaccgggaaccgaaacgggggtaaaccgaaaggggttaacggaaaacgttaaaccgaaaacggtaaaccgtagggtacggggtaccttacggaccaaccgtaacg

SEQ ID NO: 377863 - DNA, 688 bp, Homo sapiens
  misc_feature: GZ8MTXP02FVAGW.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctacaagacgtaccttaaattttagtaaggtttacctaaaccggggacttcgtcggggtaccccaaggaccacggtacttcaagccgggcaaggttcggggtcaggggcctaaacgttggtaacttttccaactacgtagaaacttaaacgtcgaacgtaagggggttgggaaagggtccgttagggaagggttacgtttagggtttagggggttttttaaattaaccgtgggtactagttacggacgtaaaagggttaccaacgtacgtcgggtaccgtgggggtaaccgtttccgggaccgaaaacgggggacctaaaggggttacggaaaacttacgaaaacggtaacgtgggttacgggaacttcggacctaccgattactacggtctttaccg

SEQ ID NO: 377864 - DNA, 575 bp, Homo sapiens
  misc_feature: GZ8MTXP02FI2ZM.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagagccaggccaatctccaagacgacctaatttataaggtttcaaccgggtactcgtggggtccccagacagattccagcggcaggtgggtcagggccatgatttcactacgtgaataaatcgacgaggggtggaggcgtaggaggtattggtttgggtttatacgtgcatgacgaaggtacactacgtggccgtgggtacgttcggacgtaaacggggaccaaagggtaacggaaactacgaaaacggaacgtaggtacggctacgccacctacgtcgtacgttcttacgtactttccccg

SEQ ID NO: 377865 - DNA, 641 bp, Homo sapiens
  misc_feature: GZ8MTXP02GTSJ8.51.86.H09.1.454.CMB.2.raw
  modified_base (267)..(267): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccaggtggggatgttgtgctgactcagtctccactcctccctgcccgtcacccttggacacgccgcctcatctctgcagtctagtcaggcctctatatagtgatagaaacactatagtattgttcagnagagccagccaatctacaagacgtacttaatttataaggtttacgaaccggctcgtcggggtacccaagacagtatccgagcgcgtaggtcggggtacagggcctacgtgtactttcaactctagtataagtcggaacggtaggggtaggaggtcgtaggtaagggtagtttgggttttaagggtttattacgtagcgtaagtcggtaacgtaacgggtaacaccgtacgtcgggtacccgtggggtaaccggttaccgggaaccgtaaacgggaaaccgtaaaagggtacggtaaaataaaccggaaaacggtacgttaggacggtactacgaaccaacgtacttcgttacgttaccttactaccgtttaccc

SEQ ID NO: 377866 - DNA, 663 bp, Homo sapiens
  misc_feature: GZ8MTXP02FT373.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactacttgaattggttcagcagaggccaggccaatctaccaagacgctaatttataaggtttctaaccgggctcgtggggtcccagacagtacttcagcggacaggtggtcaggcactgtatttcgactactgaataagtcgtaacgaggggtaggaggcgtaggaggtagttggttttaggggttttaattacgtaggtactaagtggtacgtaaagggttaacacgtaacgtgggtcccgtagggggtaccggttccgggaaccggtaaaacgggggaaccctaaaagggggtacggtaaaaagttaacccggaaaaacgggttaaccgttaggggttacggaccgttacggaacccgtaaaccttacgttaccgttcggtttacctttaccggtaaccttttacccccg

SEQ ID NO: 377867 - DNA, 694 bp, Homo sapiens
  misc_feature: GZ8MTXP02GZ377.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctcatctcctgcaggtctagtcaagcctctatatagtgatagaactacctatgaattggttcagcagaggccaggcctaatctaccaagaccgtaccttaaattttacgtaaacggtttaccgtaaacccgggtacttccgtacgggggtaccccagactagtactcgaggcggcgtaggtcggggtccgagtccgactagtactttacactacgtagtataaacgtcgaacggtaggggtaggacggtacgtagggaagggttagtttggggtttacggggtttttaaattcgtaggtaccgttaagtacggtacgttaaacgggtaaccaccgtcggtacgggtcccggtacggggttaccggttaccggggaaccggaaacgggtaaccggtaaacggggtacggtaaaacgttaaccggaaaacggtaaaccgtggttacggaaccgtacgaccgtaacgactttcgtaacgttcctttaacg

SEQ ID NO: 377868 - DNA, 648 bp, Homo sapiens
  misc_feature: GZ8MTXP02HPNUI.51.86.H09.1.454.CMB.2.raw
  modified_base (258)..(258): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacacgcccggcctccatctcctgcaggtctagtcaacggcctctatatagtgatggaaacncctacttgaattggttcagcagacgcagccaatctcaagacgtaccttaatttagtaacggtttcgtaaaccgggacttcgtaggggtacccagactagtattcgaggcggcaggtgggtcgaggcatgtatttcattacgtagtaataacgtacggaacggtaggggtagggacggcgtagggtaggttagtttggggtttacgggttttaattcgtgtacgtagtgacggtaaagtaccaacgtaggtcggtccggtaggggtaccgttacgggaccggtaaacgggtaacggtaaaggggtaaacggtaaactaaaccggtaaaacggtaccgtagggtacggtaaccgacggtaccaccgtagtccgtttacggtttcttaacccg

SEQ ID NO: 377869 - DNA, 712 bp, Homo sapiens
  misc_feature: GZ8MTXP02I74DI.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatcctcctgcaggtctagtcaacggcctcctatatagtgataggaaacacttactgtaattggttacagcagaggccaggaccaatcctaccgaaagaccgtaccttaaatttaacgttaacggttttaccgtaaaccgggtacttccggtacggggtacccagactagtacttcgaagtcggcgtaggtcgggtcgacgggctacgttgtaactttcactacgtagattaaaggtcgaaggagggggtacggagtcgtggaaggttagttgggtttaggttttaatacgttggactagttagacggtaaacgtacctacgtcggttacggggtaccgttacgggggtaaccgtttacccggggaacggtaaaaccgggggtaaaccgaaaagggggttaaccgaaaaaacgttacccggtaaaaaacgggtaacccgttgggggttaacgggccctacgggtaacccaaacccgttagtttaccgtcgtttacccgttacc

SEQ ID NO: 377870 - DNA, 599 bp, Homo sapiens
  misc_feature: GZ8MTXP02GFMK2.51.86.H09.1.454.CMB.2.raw
  modified_base (289)..(289): a, c, t, g, unknown or other
  modified_base (299)..(299): a, c, t, g, unknown or other
  modified_base (390)..(390): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatgaaacactactgaattgttcagcagagccagcaatctcaagacnctaaatttanaaggtttctaaccggactcgtgggtcccagacagatccagcgcagtggtcaggcactgattcacactgaataaatcgacgagggtaggagntgaggtatgtttgggtttatactgctatagacgtaaaggtacacgtaaccgtgggaccgttaggggtaacggttcggacccgaaaaggggaaacccggtaaaaggggttaaggggaaaactaacgaaaaaacccggtaaacgttagtaacggggacttacggaacccgaaccgtaacgttcccttaggtcgtttaccaactttaccccg

SEQ ID NO: 377871 - DNA, 620 bp, Homo sapiens
  misc_feature: GZ8MTXP02FQ2KD.51.86.H09.1.454.CMB.2.raw
  modified_base (310)..(310): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatcacaagacgtcctaaatttntaacggtttccgtaaacgggacttcgtcggggcccaaggtaccagtacttccgaggcggcgaaggtggggtccaagggctacgttgtactttacacgtaacttgtaactaagtccggagtagggggtggaaggcgttaggagggtattagggtttagggttttaaactcgtagctagtcgtagaaacggttcacgtacgtcgggtcgtacgggaacggtttccggaacgtaacggggaccaaagggtacggtaaacgtaaccaaaacggaacgtgttaagggctcgacaccgtatcgtacgtctttaccg

SEQ ID NO: 377872 - DNA, 638 bp, Homo sapiens
  misc_feature: GZ8MTXP02IU310.51.86.H09.1.454.CMB.2.raw
  modified_base (216)..(216): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacagccgcctcatctccngcagtctagtcaagcctctatatagtgataggaaactactatgtaattggttcagcagaggccaggaccaatctacaagacgtaccttaaatttagtaacggtttacctaaccgggcttcgtcggggtcccaagacagtacttcgagcggactagggtgggtcagggctacgtgtatttcgaactactagaataacgtcgacgtaggggtagaggtctaggaggtagttggtttgggtttttaaatacgtggactagtcgacgtaaacggtacacgtacgtgggtacccgtaggggtaccgttacggacccggtaaaaggggaccgaaaaggggtacggaaaacttaacggaaaacggtaacgttgggttacggaaccgtacggaacccgtaccgtaacttcgttcggtttacctttaaccg

SEQ ID NO: 377873 - DNA, 621 bp, Homo sapiens
  misc_feature: GZ8MTXP02HWMKN.51.86.H09.1.454.CMB.2.raw
  modified_base (386)..(386): a, c, t, g, unknown or other
  modified_base (451)..(451): a, c, t, g, unknown or other
  modified_base (476)..(476): a, c, t, g, unknown or other
tcagcgatcgtatacacgaccggtgctcgatttagtgctatagacttggggtttggggactgatcaggactcctcagttcaccttctcacaatgaggctccctgctcagctcctggggctgctaatgctctgggtcccaggttccagtggggatgttgtgctgactcagtcctccactcctccctcgcccgtcacccttggaccacgcccggcctccatctcctgcaggtctagtcaacggtccctctatatagtgataggaaaccacctacttgtaaatttcggttacagcgagacggcaggccaatcctccaaagaccaccttaaatttagtaacggtttacaacgggacttcgtaggggtacccagtacagtactcaggtcgnacggttgggtcaggctactgtaacttcaactactagaataagcgaacgaggggtgagtcgtaggnggtgttgtttagggtttatagtcgntagtgactaaaggtcacgacgtcgggcgttcggggtacgttcccgggaacggtaaaacgggaccggtaaagggtacgtaaaacgtaccgtaaaacgccggtagtacgggctacggaacctaactacgtcttacgttccgttaccg

SEQ ID NO: 377874 - DNA, 638 bp, Homo sapiens
  misc_feature: GZ8MTXP02HDP1A.51.86.H09.1.454.CMB.2.raw
  modified_base (253)..(253): a, c, t, g, unknown or other
  modified_base (410)..(410): a, c, t, g, unknown or other
  modified_base (431)..(431): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagccggcctccatctcctgcaggtctagtcaaggcctctatatagtgatggaaacncctattgattggttcagcagagccaggccaatctaccaagaccgtaccttaatttacgtaaggtttcctaaaccgggacttcgtggggtacccagacagtatccgagcggcaggtggtacaggcacgtgtacttcacgtactgaactaatcgaacgngggtaggaggcgtaggaggtnttgggtttacgggtttatcgtgtactagtgacgtaaacggttacaacgtacgtcgggtaccgtggggtaccggttcggaaccggaaaggggaacccgtaaaaggggttacggaaaacttacccggaaaaaggtaccgttaggtacgggtacctacggaaccgtaacctacgttccgttacggttacctttaccgtacgtttcccccg

SEQ ID NO: 377875 - DNA, 683 bp, Homo sapiens
  misc_feature: GZ8MTXP02IWTZY.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactcctccctgcccgtcacccttggacacgccggcctccatctcctgcaggtctagtcaacggcctctatatagtgataggaaacctaccttatagtaatttggttacagcgagacggccaggaccaatcctacgaaagaccgtaccttaaatttagtaacggtttacccaaaccgggtcttcggtacggggtaccccaagaacctagtattaccgaggccggtacagggttcgggcacgggtcacgttagtactttacaacgtactagtaaattaaacgtccggtaaggtaagggggtgggaagggtctagggaaaggttagtttaggggttttacgggtttttaaattacgttagggacttaaggtagttacggaaaaggtacccaaacgtacgtcgggtcgtacggggtaccgttcgggaaaccggtaaacgggaccgtaagggtacggaaaattacggaaaacgtacgtggtacggctacgaccgtacatcgtagttccccttag

SEQ ID NO: 377876 - DNA, 639 bp, Homo sapiens
  misc_feature: GZ8MTXP02JQJP8.51.86.H09.1.454.CMB.2.raw
  modified_base (258)..(258): a, c, t, g, unknown or other
tcagcgatcgtatacacgaccggtgctcgatttagtgctatagacttgggtttgggggatcaggactcctcagttcaccttctcacaatgaggctccctgctcagctcctagggctgctaatgctctgggtcccaggttccaggtggggatgttgtgctgactcagtctccactcctccctgcccgtcacccttggacacgccggcctccatctcctgcaggtctagtcaaggtcctactatatagtgataggaaacncctatgaattggttcagcagagccaggccaatcctaccaaagaccgtaccttaaatttagtaacggtttcctaaaccgggtactcggtaggggtccccaagaccagtattccgagcggctaggtggtcaggcacgtgtacttcactactgaataaacgtcgaacgtaggggtggaggtcgtaggaggtattggtttagggtttatcgtagctagtcgagaaaggttacacgtacgtgggaccgttaggggtaccggttacggaaccgtaaacggggtaaccgtaaaggggtacggaaaacgttaccggaaaacggtacgttagggacggtcgtacggaacctaacccggtattcgtacgttcctttacctacgtttccccg

SEQ ID NO: 377877 - DNA, 685 bp, Homo sapiens
  misc_feature: GZ8MTXP02GMB6V.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtcctccactcctccctcgcccgtccacccgttggacacggcccggcctccatcctcctgctaggtctagtcaacgtcctctatatagtagagtacggaaactactacttgtaattggttcagcaggacggccaggaccaatcctaccaagaccgtacctttaaatttacgttaacggtttaccgtaaccgggacttcggtacggggtacccagactagtactacgaggcggcgtagggtgggtcgacggactacgttagtactttacaactacgtagtaaacttaaacgtacggaacgggtagggggtaggaggtcggtaggtaagggttagtttagggttttaggttttacgtcgtaggtactagttagacggtaacgtaccacgtcggtacgggtcggttagggaccggttacggaaccggaaacggggtaaccaaaggggtaaccgaaaacgtacgaaaacgtacggtaggtcggtcgtaccacgtaaacctcgtttctacgttactttaccg

SEQ ID NO: 377878 - DNA, 693 bp, Homo sapiens
  misc_feature: GZ8MTXP02I0ZXK.51.86.H09.1.454.CMB.2.raw
  modified_base (180)..(180): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatggttgtgctgactnagtctccactctccctgcccgtcaccttggacacgccgcctccatctctgctaggtctagtcaacggcctctatatagtgatagaaacactactgtaattggttcagcaggacggccaggccaatcctacaacgacgtacccttaaagtttagttaaacggtttacctaaccggggtactccgtccggggtacccagactagattaccgagcggacgtaggtcggggtacagggactacgttacgtaacttcaacacgtacgtaataaagtacggacggtaaggggttgggagggtacgtaggaagggttagtttagggtttaggggtttttaattaccgtggtacgtaagtggaactaacggggtaactaccgtacggtacggggtaccgttacgggggtaccgtttaccggggaccggtaaacggggtaaaccggtaaagggtaaacgggtaaactaaaaccgaaaacggtaacgttacgggtaacggtcgtacggacctaccggtttaac

SEQ ID NO: 377879 - DNA, 627 bp, Homo sapiens
  misc_feature: GZ8MTXP02GPES0.51.86.H09.1.454.CMB.2.raw
  modified_base (214)..(214): a, c, t, g, unknown or other
  modified_base (246)..(246): a, c, t, g, unknown or other
  modified_base (279)..(279): a, c, t, g, unknown or other
  modified_base (332)..(332): a, c, t, g, unknown or other
  modified_base (352)..(352): a, c, t, g, unknown or other
  modified_base (612)..(612): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacacgccgcctcatcncctgcaggtctagtcaggtcctctatatagtnagtagaaactctattgtaattggttcagtcagnggccaggaccatccacacgactaccttaatttagtaaagtttcaaaccgggtntcgtacgggtccagacagtntcgagcggacgaggttcgggcgacggtctacgtcgttaactttacaaccgtactagtactaaactcggaacggaggggttgggaaggtcgtagggaaggttagtttagggttttacgggttttaaatacgtagtacgtagtcggtagtaaacgggtacaccgtacgtgggtaccgttgggtacgttacggaccgaaagggtaacccgaagggttaacgaaaagtacctaaaaggaccttggtacggctacggactacgtntactcgtacttaccg

SEQ ID NO: 377880 - DNA, 682 bp, Homo sapiens
  misc_feature: GZ8MTXP02GYLJ0.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaagcctctatatagtgatagaaacacctacttgaattggttcagcagacgccaggccaatctaccaagacgtaccttaaatttagtaaacggtttaccgtaaacccgggtactccgtacggggtcccaaggacacgtattcgagcggacaggtcgggtcagggcacgtgtactttacaacctacgtagaattaaacgtcgaacggtagggggttacggaagggtcgtagggtaaagggtagtttgggttttacggggtttttaaattcgtagcgtaagtggtacgtaaaggttaccaacgtaccggtagggtcccgttagggggtacccggtttcgggaacccggtaaaaggggaacccggtaaaggggtaaggtaaaactaccggtaaaaacgtacgttaacggggtcggaaccttcggaaccgtaacctagttaccgtagtttctttaaccc

SEQ ID NO: 377881 - DNA, 657 bp, Homo sapiens
  misc_feature: GZ8MTXP02GEFX3.51.86.H09.1.454.CMB.2.raw
  modified_base (278)..(278): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacagccgcctccatctcctgcaggtctagtcaaggcctctatatagtgataggaaacacctattgaattggttcagcagnggccaggcaatctacaagacgaccttaatttataaggtttcctaaaccgggtctcgtcggggtcccagaccagtatcaggcgcaggtgggtcaagggcaacgtgtatttacgactactagaataaagtcgacgaggggtggagcgtggaggtattgggtttacgggttttattacgtgtacgtaagtaggtacgaaacgggttaccacgtaacggtcgggacccggtttgggggaaacccggtttccggggaaacccgggtaaaacgggggtaacccggtaaaaggggtacgggtaaaaaacgtaccgaaaaacgggtaccgttagggtacggccgttaacggacctaaacccgttattaccgttacgttacctttacg

SEQ ID NO: 377882 - DNA, 644 bp, Homo sapiens
  misc_feature: GZ8MTXP02GWRA8.51.86.H09.1.454.CMB.2.raw
  modified_base (281)..(281): a, c, t, g, unknown or other
  modified_base (358)..(358): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccaggtggggatgttgtgctgactcagtctccactcctccctgcccgtcacccttggacagccggcctccatcctcctgcaggtctagtcaaggtcctcctatatagtgatacggaaacacctattgaattggttcagcagngcagccaatcacagctctaattatagttcaaccggctcgtgggtcccagacagtatccgagcgcagtggtcagggcnctgtacttcacactagattaaagcgacgtaggggtggaggtcgtaggaaggtagtttacgggttttggttttaaacgtcttaggtactaagttcgaaccgtaaaggttaccgaacgtaaccggttcgggtacggtacggggtaaccggttaccggaacccgggtaaaaggggaacccgtaaaaggggtaaacggttaaaacgtaaccggaaaaaacggtaccgtacggtacgggacctagaacccgtaactaacgttcgttcgttaccttcgaaacgtttcccccg

SEQ ID NO: 377883 - DNA, 643 bp, Homo sapiens
  misc_feature: GZ8MTXP02GIVYA.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaaacacctacttgaattggttcagcagaggccaggccaatctaccaagacgccttaaatttataaacggtttctaaaccgggactcgtggggtcccagacagattcagcggcaggtgggtcaggctacgtgtacttcactactgaataaactcgaacggaggggtaggacggcgtaggagggtattaggttttaggggttttaattacgtgtacgtagttagaacggtaaaggttaccaactaacgtcgggtaccggtggggtaaccggtttcgggaacccggaaaacggggtaccgaaaaggggttagggaaaaacttacggaaaaaccggaaccgtagggtacggtaaccgtacggacctaaccgtacgtaccgttcggttactttaccg

SEQ ID NO: 377884 - DNA, 754 bp, Homo sapiens
  misc_feature: GZ8MTXP02FQECZ.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacagccgcctccatctcctgcaggtctagtcaaggcctctatatagtgataggaaacacctacttgaattggttcagcagaggccaggccaatcctaccaaagaccgtaccttaaattttaagtaacggtttaccaaacccggggtacttccggttacggggtaccccaaaggaccaaggtacttaccgaaggccgggacgtaagggttcggggtccgaacggggcctaaaccgttgtaaactttttaccaaacgtaaccgttaggaaattaaaacgtccgggaaacggtaaggggggttagggaagggtccgttagggtaaggggttaagtttacggggttttaagggggttttttaaacttaacgtggtactaagttacgggaacgtaaaggttaccaaccgtacgtcgggtacccgtacggggtaaccggtttcggaacccggaaaaggggacccgtaaaggggttaacggaaaaacgttaacgaaaaccggtaacgtggttacggaacgttacggaacctaacccgtatttccggttacgttacctttaccg

SEQ ID NO: 377885 - DNA, 642 bp, Homo sapiens
  misc_feature: GZ8MTXP02FT33Y.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacacgcccgcctccatcctcctgcaggtctagtcaaggtccctactatatagtgatacggaaactctattagaattggttacagcaggacggccaggcctaatcctacaagaccgtaccttaaagtttacgtaacggtttaccgaaaccggtacttcggtacggggtccaaagacagtacttcaggcgacgaggtgggtcgaggctagtcgtatttacactactagaataacgtcgaaggtagggtggaggctaggaggttagttaggtttaggttttatacgtgtactagtacgtacgaaacgtacccagtaccgtcgggttaccgtaggggtaccgttcgggaaaccgtaaaggggaaccgtaaagggttacggaaaactaacgtaaaaccggtacgtggtaacgcgtacggaccctaaacgtctcgttacgtcctttaacg

SEQ ID NO: 377886 - DNA, 647 bp, Homo sapiens
  misc_feature: GZ8MTXP02GR1YL.51.86.H09.1.454.CMB.2.raw
  modified_base (257)..(257): a, c, t, g, unknown or other
  modified_base (272)..(272): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacacgccgcctccatctcctgcaggtctagtcaaggcctctatatagtgataggaaacnctacttgattggttnagcagaggccaggccaatcctaccaaagccgtaccttaatttagtaacggtttccgaaaccgggcttcgtacggggtcccagacaagtacttcgagcggcaggtcgggtcagggtcacgttagtactttcgaaactacgtagtaactaaaggtaccggtaggaacgggggtgggtaacggcgtaagggaggttaagttgggtttaggggtttttaaatacgtgtactagttacgacgtaaacggtaccactaccggtggtccggtacggggtacgttacggaccgaaaacggggaccgaaaggggtaaacgtaaactacggaaaaacgtccgtaggttacgctacggactaacctagttcgtcgttaactttccg

SEQ ID NO: 377887 - DNA, 694 bp, Homo sapiens
  misc_feature: GZ8MTXP02IKV81.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcaccttggacacgccggcctcatctcctgcaggtctagtcaaggcctactatatagtagataggaaactaccttacttagtaatttggttaccagtcgaggacggaccaggacctaatcctaccgaaaggtaccgtacctttaaagttttaacgttaaacgggttttaccgtaaacccggggtacttccggttaccgggggttacccccaagtactaagtatttaccgaaggccggtagtaggggtcgtacgacgggtcacgttgtaactttacgacctagtagaagttaacgtacggaacgtaggggtaggagtacgtaggtaggtagtttggtttaggtttttaatacgtagactagtagacgtaacgtacacgtacgtacggaccgttacgggtaccggttaccgggaacaaacggggtaaccgtaaggggtaaacgtaaacgtaacggtaaaacgtacgtacgggtacggactcggaacctaccgttacg

SEQ ID NO: 377888 - DNA, 607 bp, Homo sapiens
  misc_feature: GZ8MTXP02J2WWH.51.86.H09.1.454.CMB.2.raw
  modified_base (258)..(258): a, c, t, g, unknown or other
  modified_base (266)..(266): a, c, t, g, unknown or other
  modified_base (287)..(287): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgccccgtcacccttggacagccggcctccatctcctgcaggtctagtcaggcctctatatagtnatgaaacncctatgaattggttcagcagngccagtcaatcacaagacgctaatttataggttcaaacgggctcgtcggggtacccagtacagtacttcgacggcggcaggtcggggtacagggctaacgtgactttacactactagtaactaaagtcggaacagggggtggagggtacgtaggtacgggtagtttggtttaggggttttacttacgtggactagtagacgtaaggtacgactagtcggacgttcgggacgttacggaccggaaacgggtaaccgaagggtaacggtaaacgtaacgtaaacggtaaacgtggtacggtaccgtacggacctaacctacg

SEQ ID NO: 377889 - DNA, 566 bp, Homo sapiens
  misc_feature: GZ8MTXP02JBUHI.51.86.H09.1.454.CMB.2.raw
  modified_base (384)..(384): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatctcctgcaggtctagtcaaggcctcctatatagtgatggaaacacctattgaattggttcagcagagccaggccaatctcaagacgcctaatttataaggtttctaaccgggactcgtcggggtcccagacagattccagcgcagtggcaggcactgattcacactgaatatcganagggtgagcgtgaggtattggtttgggtttatactgctagtgacgaaggtacacgacgtcggcgtaggggtacgttccggacgaaagggacccgaaagggtaggaaaacgtacgaaaacgaaccgtggtacggcctacggaacctaccgtaactccgtaggttccttacctacgtttccccg

SEQ ID NO: 377890 - DNA, 671 bp, Homo sapiens
  misc_feature: GZ8MTXP02FFM5Z.51.86.H09.1.454.CMB.2.raw
  modified_base (410)..(410): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtcctccactctccctgtccgtcacccttggacagccggcctccatctcctgcaggtctagtcaaggcctctatatagtgatggaaacacctacttgaattggttcagcagacggccaggccaaatctaccaaagacgtaccttaaattttataacggtttcaaaccgggacttcgtcggggtccagacagtatcagcgcaggtgggtcaggcatgtatttcactactgataaagtcgaacgnggggtaggaggcgtaggaggtagttggtttaggggttttaattaacgtggactaagttcggaacgtaaaggggtacccaacgtaaccggttcggggtacccgttgggggtaaccggttttaccggggaacccggtaaaacgggggaaaccccggtaaaaggggttaaaggggaaaaactttaaccgaaaaaccgggtaaaaccgtggttacggggaacttacggaccaaacccgtagtttacctcggttcctttaaacccg

SEQ ID NO: 377891 - DNA, 690 bp, Homo sapiens
  misc_feature: GZ8MTXP02G3DUM.51.86.H09.1.454.CMB.2.raw
  modified_base (259)..(259): a, c, t, g, unknown or other
  modified_base (280)..(280): a, c, t, g, unknown or other
  modified_base (292)..(292): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctcgcccgtcacccttggacacgccggcctccatcctcctgcaggtctagtcaaggcctctatatagtgataggaaacnctactgaattggttcagcagnggccaggccaanctcaagcgtacctaatttagtaagtttcgaaccggtactcgtgggtcccagacagtattcaagtcgggcaggtcgggtcgacgggactaccgttgtaacttttcgaaactacctagtaaattaaacgttacgaacggtagggttagggaacgtcgtaggtaggtaagtttgggtttacgggtttttaatcgtacgtagtagttaggaacgtaacggttaaccgacgtaacggttcgggtacccgtagggggtaaccggtttaccgggaaaccgggtaaaacggggtaaccggaaagggtttaaacgggaaaactaaaccggtaaaaaccggtacgttacggtaaagggtccgtacggtaaacccaccttaacgttccggttacgtttacctttacccg

SEQ ID NO: 377892 - DNA, 751 bp, Homo sapiens
  misc_feature: GZ8MTXP02IKNWW.51.86.H09.1.454.CMB.2.raw
  modified_base (259)..(259): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcaccttggacacgccgcctcatcctcctgcaggtctagtcaaggccctctatataggtnaatacggaaactaccttacttagaagttttggttacagccgaaggacggccgtaacgggccctaaacgttacccttaccgaaaacggtacccgttaaacccttttaaaagtttttaagttaaaaccgggtttttacccgtaaaaccccggggtacttccggttacccgggggtaccccaaggaacctaggtactttcgaacgggccgggtacgtaacggggtcgggggtaaccacgggtacctacgtttacgtaactttccaaccttacgtaagtaataaacgtcggaacggtagggggtagagggtacgtggtagggttaggtttaggttttcgggtttttaaatcgtacggacttagacgtacggtaaggtacctacgtacgttcgggcggttacgggtaccggttaccgaacggtaaacgggaaccgtaagggtaacgaaacgttaaacggaaacgttacgaggttacggactaccgaccgaccttacg

SEQ ID NO: 377893 - DNA, 736 bp, Homo sapiens
  misc_feature: GZ8MTXP02G4QSL.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccgcctccatcctcctgcaggtctagtcaaggtcctctatatagtgataggaaacactacttgaattggttcagcagagccaggccaatctaccaaagaccgtaccttaaattttacgtaacggttttccaaacccggggtacttccgtacgggggttacccccaaggtaccaaggtactttaccgaacggccgggtcaaggttcggggtaccaagggtcctaacgtgtacttttacaacctacgttagattaaagtacccggaacgtagggggttaggaaggtccgtaggtaagggtagttagggttttaggggtttttaactacgttcggacctaagtcgttacggaaacgggttaccaaaccgtacggttcgggtaccggttaggggtaccggtttaccgggaacccgtaaaacgggggtaacccaaaagggggttacggaaaaacgttaaccgaaaacgggaaccgtttagggtacggaacgttacggaacctaacccgttaataccccgtttaggtttcctttaacccgg

SEQ ID NO: 377894 - DNA, 614 bp, Homo sapiens
  misc_feature: GZ8MTXP02FKA9G.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaaatctaccaagacgacctaaatttataaggtttcctaaaccgggacttcgtcggggtccagacacgattacagcggcaggtgggtcaggcactgatttcacactgataatcgacgagggtggaggctggaggtattggtttaggttttatacgtgtactagtggtaccgtaaggtaccacgtacgtgggtaccgtggggtacggtttccgggaccgaaacgggggaaccgaaggggttaaacggaaaacgttaccgaaaacggtaaaaccgtggttaggaaccgttacggacccgtaacctaagttccgtacgtttcctttaaccg

SEQ ID NO: 377895 - DNA, 573 bp, Homo sapiens
  misc_feature: GZ8MTXP02FMIYT.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctcaagacgcctaatttataaggtttcaaccggactcgtggggtccagacagatccagcgcagtggtcaggcactgatttcactactgataaatcgacaggggtgaggctaggaggtattggtttgggtttattacgttgctagttggactaaagggtacaacgaacgtcgggaccgtggggtacggttccgggaccgtaaacgggggaccgtaaaacgggtaggaaaactacgaaaacgaaacttgggtacggcctggaaccaccatcgtgtctactactttccg

SEQ ID NO: 377896 - DNA, 636 bp, Homo sapiens
  misc_feature: GZ8MTXP02JSWTB.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttgacagccgcctcatctcctgcaggtctagtcaaggcctctatatagtgatagaacacctacttgaattggttcagcagaggccaggccaatctacagacgcctaattataggtttcgtaacggactcgtcgggtccagacagattcccgagtcggcaggtggtcaggcactgtactttccatactagataactacgacggaggggttaggaggtcgtaggaggtagttgggtttgggttttagttacgtgtactagtggctaaagggtacactacgtcggtacgtcggggtaccggttccgggaaccgtaaacgggggaaacccgtaaaggggtacgggtaaaacgttaaccggaaaacggtaaacgttacgggtacggggaccttacgggaacctaaccggtaccttacgtacggtttacctttacggtaacctttcccccgg

SEQ ID NO: 377897 - DNA, 711 bp, Homo sapiens
  misc_feature: GZ8MTXP02GEONQ.51.86.H09.1.454.CMB.2.raw
  modified_base (387)..(387): a, c, t, g, unknown or other
  modified_base (694)..(694): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctcgcccgtcacccttggacacgcccggcctccatctcctgcaggtctagtcaacggcctcctatatagtgatacggaaacactacttgtaattggttcagcaggaggccaggaccaatcctaccaagtacgtacttaaatttagtaaacggtttccgaaaccgggtacttcggtacggggtaccagactacgtacttcgagcgganacggtagggtcacgggtactacgttagtaactttcgaaactacgttagtaaagttaaacgtacgggaacggtacgggggttaggggaacggtcggttaggaaaggggtttattttagggggttttacgggtttttaaacttacgtggtacttaacggtacgtaaaccgggtaagttaaaccgaccgttaacgtcggggttacccggtagggttaacccgggtccgggaaaccgtaaacgggggaacccgtaaaggggtacgaaaacgtacgaaaaccgtacggtgtagggcctacggacaaccgttntcgttacgtcttaaccg

SEQ ID NO: 377898 - DNA, 593 bp, Homo sapiens
  misc_feature: GZ8MTXP02JGXLR.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctgggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggttcagcagaggccaggccaatctaccaagacaccttaaatttataaggtttactaaccggactcgtcggggtcccagacagatcagcggcaggtgggtcaggcatgatttcacactgaataagtcgacgtaggggtggagcgtaggaggtattggtttagggttttatacgtggactaagtcgacgtaaggtacacgtacgtggtcccgtaggggtaccgttacggacccggaaaggggacccgtaaaggggttacgggaaaacttacgaaaacggaacgtttgggacggtactacggacctacccgtaacg

SEQ ID NO: 377899 - DNA, 588 bp, Homo sapiens
  misc_feature: GZ8MTXP02H4OEV.51.86.H09.1.454.CMB.2.raw
  modified_base (264)..(264): a, c, t, g, unknown or other
  modified_base (284)..(284): a, c, t, g, unknown or other
  modified_base (292)..(292): a, c, t, g, unknown or other
  modified_base (297)..(297): a, c, t, g, unknown or other
  modified_base (304)..(304): a, c, t, g, unknown or other
  modified_base (309)..(309): a, c, t, g, unknown or other
  modified_base (336)..(336): a, c, t, g, unknown or other
  modified_base (348)..(348): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggctcatctctgcagtctagtcaaggcctcctatatagtgatggaaacncctactgattgttcagcagngcagcatncagcnctattanagttnacggactgtcgggccagacagatcagngcaggtcgggtnaggcacttgaactttcactacgtagtaataatcgaacgaggggtaggacgtgtagaaggttattgggtttagggttttattacgtggtactaagttggaacttaaaggtacaacgtaacgttcgggacccgttaggggacgtttaccgggaccgtaaaaggggaacccgtaaggggtaacgaaaacgtacccgtaaaaggaaaccgttagggttccgaacgtcggaccaaaccggttacg

SEQ ID NO: 377900 - DNA, 655 bp, Homo sapiens
  misc_feature: GZ8MTXP02HT1CU.51.86.H09.1.454.CMB.2.raw
  modified_base (253)..(253): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctggtccaggttccagtggggatgttgtgctgactcagtctccactctccctgcccgtcacccttggacagccggcctccatctcctgcaggtctagtcaaggcctctatatagtgatggaaacnctatgaattggttcagcagagccagccaatcctacaagacgtaccttaaatttacgtaacgtttccgtaaacgggtctcgtcggggtacccagacagacttcagccgataggtggcaggcatgtattcactactagaataagtacgaacgaggggtaggaggtacgtaggtacggtagtttggtttacgggtttttaatttacgtgtacgtaagttggacgtaaacggtaacctacgtacggttacgggtaccggttaggggtaacccggttcgggaaaccggtaaaacgggggaacccggtaaaaggggtaaggtaaaacgttaaccgaaaaccggtaaaaccgttgggtacggaaccgttacggaacctaccgtacgttaccttcggtttacctttaccg

SEQ ID NO: 377901 - DNA, 670 bp, Homo sapiens
  misc_feature: GZ8MTXP02ICCFR.51.86.H09.1.454.CMB.2.raw
  modified_base (241)..(241): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacacgccggcctccatctcctgcaggtctagtcaagcctctanatagtgataggaaactactacttgaattggttcagcagacggccacggcaatctaccaagaccgtacttaaatttaagtaacggtttaccgaaccgggtacttcggtcggggtaccccaaggacaggtacttcgaggcggcgtaggtcggggtcgagggtactaacgttagtactttacactactagaaattaaacgtacggacgtagggggtagggaggtcgtaggtagggttagttagggtttaggtttttaagttaacgtgggtactagttacggacgtaaacggtacgacgtacggtcgggccgttaggggtaccggttaccgggacccgtaaaggggaacccgaaaggggtacggtaaaactacgtaaaaacgtacgtaggtacggtcgtacggacctacctagttcccgtacgttctttaccg

SEQ ID NO: 377902 - DNA, 601 bp, Homo sapiens
  misc_feature: GZ8MTXP02JAKSZ.51.86.H09.1.454.CMB.2.raw
  modified_base (492)..(492): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacacgccggcctccatcctcctgcaggtctagtcaaggtcctctatatgtgatagaactctatgattgtcagcagaggccaggccaatctacgaagacgtacctaatttataacggtttaccaaaccggggtcttcggtcggggtacccaggacagtactacgagcggctagggtcgggtcagggctacgttgtactttcactacgttagaattaaacgcgaaggaggggtaggagtcgtagggtaggtagttaggtttagggttttatacgtgctagtgacgtaaagtcacgngtcggcgtcgggacgttcggacggtaaacgggactaagggtacggaaactacggaaaacgtacgtggacggtctacggacctacgtattacggttacgttaccttaccg

SEQ ID NO: 377903 - DNA, 521 bp, Homo sapiens
  misc_feature: GZ8MTXP02FHL1W.51.86.H09.1.454.CMB.2.raw
  modified_base (386)..(386): a, c, t, g, unknown or other
  modified_base (392)..(392): a, c, t, g, unknown or other
  modified_base (434)..(434): a, c, t, g, unknown or other
  modified_base (483)..(483): a, c, t, g, unknown or other
  modified_base (512)..(512): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttgacagccggctccatctcctgcaggtctagtcaaggcctcctatatagtgatggaaacacctacttgaattggttcagcagaggccaggccaatctccaagacgcctaaatttataaggtttcaaccgggactcgtggggtcccagacagattcagcgcagtgggtcaggcactgatttcacactgataancgtacnggtgagctgagatgttggtttatactgcatgacaaggtccanactggtcctaggggacgttcggcccgaaagggaccaaaggtacggaaanacaaaacgaactgtcggctgacaccatcncgtcttacc

SEQ ID NO: 377904 - DNA, 751 bp, Homo sapiens
  misc_feature: GZ8MTXP02JXNRR.51.86.H09.1.454.CMB.2.raw
  modified_base (258)..(258): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacagcccggcctccatctcctgcaggtctagtcaaggcctctatatagtgataggaaacncctacttgaaatttggttacagcaggacggccaaggcccaaatcctaccaaacgaccgtaccctttaaaagttttaacgtaaacgggttttccgtaaaacccggggtcttccggtacgggggtaccccaaggacctaagtattcgaggtccgggacaggttggggtccaagggctacgttagactttacgactaactgtaattaaacgtcgaacggtagggggtagggacggtacgtagggtaagggtagtttagggtttttggggtttttaaacttacggttggtaccgtaaagtcgggtaacgtaaacgggttaccaaccggttaaccggtcggggtacccgtagggggtacccgggtttccggaaaccggtaaaaccggggaaaccgtaagggggttaaacggaaaacgtaccgtaaaaaccggtaacgttaacgggtcggaaccgttacggaccctaaccggtactttccgttcggtaacttttacccg

SEQ ID NO: 377905 - DNA, 542 bp, Homo sapiens
  misc_feature: GZ8MTXP02G91O7.51.86.H09.1.454.CMB.2.raw
  modified_base (288)..(288): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagagccaggccaatcnccaaagacgacctaaatttataaggtttcaaaccgggactcgtggggtcccagacagattccagcggcagtgggtcaggcactgatttcacactgaataatcgacgaggggtggaggctagaggattggtttgggtttatacgtgctatgactaaggtacacacgtggccgtggggacgttcggaccgaaagggaccaaagggtggaaatacgaaaacgactgacgctagaacacatctgtcttacacttcccg

SEQ ID NO: 377906 - DNA, 702 bp, Homo sapiens
  misc_feature: GZ8MTXP02HLGAR.51.86.H09.1.454.CMB.2.raw
  modified_base (250)..(250): a, c, t, g, unknown or other
  modified_base (258)..(258): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagcccggcctccatcctcctgcaggtctagtcaaggccctactatatagtnatgaaacnctacttgaattggtcagcagacggccaggccaatctacaagtccgtacttaaatttagtaaacggtttccgaaaccgggtacttcggtacggggtaccccaaggtacaacggtacttacgacggtccgggactaggggttcgggtaccacggggtactaaccggttgtaactttccgaaactcgtacgtaaattacgtacgacggtaggggttaggagggtacgtaggtaacggttagttaggttttagggttttaacgttacgtagggtacttagttacggaacgtaacggtacctacgacggtacggtaccggtggggtaccgttacgggaaccggtaaacggggtaaaccggtaaagggtaaacggtaaaccgttaacgaaaaccggtaacgttcggacggtaacgtcggaacctacgtagtccggttacttccgtttacg

SEQ ID NO: 377907 - DNA, 675 bp, Homo sapiens
  misc_feature: GZ8MTXP02FPTIA.51.86.H09.1.454.CMB.2.raw
  modified_base (483)..(483): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtctccactctctctcgccccgtcaccttggacacgcccggcctccatctcctgcaggtctagtacaacggtcctactatatagtagatacgaaactacctagttagtaactttggttacaagcgaacggacggacccaacggacctaatcctaaccgaaacgtaacccgtaacctttaaagtttttaacgtaaacggtttaccgtaaacccgggtcttccggtacggggtacccaggaacagtacttacgacggcggacgtagggtacggtcgaacggctacgttgtactttcgactagtanaattaacgcgaagaggggtgacgtgtaggtagtagtttggtttaggtttatacgtagactagtagtaacgtaacggtacacgacgttccggacgttacggggtacgtaccgggaaaccggaacggggtaaccgtaaaggtaacgaaacgtaaacggaaacgtacggtacggtacggacgtacgacgtaaccg

SEQ ID NO: 377908 - DNA, 561 bp, Homo sapiens
  misc_feature: GZ8MTXP02IT3WU.51.86.H09.1.454.CMB.2.raw
  modified_base (274)..(274): a, c, t, g, unknown or other
  modified_base (283)..(283): a, c, t, g, unknown or other
  modified_base (288)..(288): a, c, t, g, unknown or other
  modified_base (291)..(291): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacactatgaattgttcagcagngccagccancacanacnctaattataagtttcaacggctcgtgggtaccagacagatcagcggacaggtgggtcaggtcacgttgtattcactactagataaactcgacgaaggggtgaggtcgtagagggtattggtttaggtttattactggactagtgacgaaaggtacacgacgtggtccgtaggggtacgttaccgggaccgtaaaaggggacccaaaggggttacgaaaagttaccgaaaacgaacgttgtaggcctgacaccgtatcgttgttaccttac

SEQ ID NO: 377909 - DNA, 664 bp, Homo sapiens
  misc_feature: GZ8MTXP02JEK13.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaacggcctcctatatagtgataggaaacactacttgtaattggttcagcagaggccaggcaatctacaagacgtacttaatttataaggtttctaaccggctcgtcgggtcccagacagtattccgacgtcggcgtaggtgggtcagggtctacttaggtactttacgactaacgtacgaagttaaacgtccgaaaggagggggtacggaggtacgtggaggttagtttgggttttagggtttacttagtcgtagtagttacggtaacgtaacggttacacgtacgtcgggtacccggtacgggtaccggttaccggaacgggtaaaacggggtaaccgtaagggggttacggaaaaactaccggaaaaacgtaacgtttggggacgtaccgtcgaaccacgtaacgttactacggttacctttcaacgtttcccccg

SEQ ID NO: 377910 - DNA, 725 bp, Homo sapiens
  misc_feature: GZ8MTXP02IUD02.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactcctccctgcccgtcacccttggacacgccggcctccatctcctgcagtctagtcaaggtcctctatatagtgataggaaactaccttacttgtaactttggttcagcgaggacggccacggaccaatcctaccgaaacgtaccgtacctttaaaagttttaagtaaacggtttttacccgtaaacccggggtcttaccggtacgggggtacccccaaaggaccgtaacgtaactttaccgacggtccggtaacgtaggggttacgggtcgaaacgggcctaacgttgtaactttccgaactacgtagtaacgtaaacgtacggaacgagggggttagggaacggtgtaggtaagggtagtttggggttttagggtttttactacgttgacgttagtacggtagaaaacggttccaacgttacggtcgggtaccgttaggggtaccgttaccggggaaccggtaaacggggaaccgtaaagggtacggaaaactaacggaaacgtaacgtggtacggcgtacggactacctagtcttacgttactttacc

SEQ ID NO: 377911 - DNA, 626 bp, Homo sapiens
  misc_feature: GZ8MTXP02IC3BF.51.86.H09.1.454.CMB.2.raw
  modified_base (249)..(249): a, c, t, g, unknown or other
  modified_base (260)..(260): a, c, t, g, unknown or other
  modified_base (369)..(369): a, c, t, g, unknown or other
  modified_base (467)..(467): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccttggacacgccggcctcatcctcctgcaggtctagtcaacggtcctctatatagngataggaaacnctatgtaattggttcagcagagccaggccaatctacaagacgacctaatttagtaaggtttcaaaccgggtctcgtcggggtacccagacagacttcgagcgactaggngggtcagggctacgttgtactttcaactacgtacgtataatcggacgagggggtgaggtcgtggaaggtagtttggtttagggtttttaattgttcgngtagttacggacctaaaggtacgaactcgtgggtcccggtagggtaccggttacgggacgaaacgggtaaccgaaggggttaaagaaaaccgttaaacgaaaacccggaagttacgggtcgaacgttacgacgactacgttcttacgtttcctttaccg

SEQ ID NO: 377912 - DNA, 595 bp, Homo sapiens
  misc_feature: GZ8MTXP02JQOTT.51.86.H09.1.454.CMB.2.raw
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagagccaggccaatctccaagacgtacctaatttataaggtttcgtaaccggactcgtcgggtcccagacagtatccgagcgcaggtggtcaggcacgtgtactttcactactgaataaatcgaacgtggggtaggaggcgtaggaggtagttgggtttagggtttacttacgtggactagtcgacgtaacggtacaactacgtcggtaccgtaggggtacgttccgggaccgtaaagggaccgtaaagggtacggaaaacgtacgaaaacgtaacgtggacggtactcggaactaccgattcgtagtccttacactttcccg

SEQ ID NO: 377913 - DNA, 791 bp, Homo sapiens
  misc_feature: GZ8MTXP02F32RJ.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtgggatgttgtgctgactcagtctccactctccctgcccgtcacccttggacagccgcctcatctcctgctagtctagcaacggccttcctatagtagtgagtacgaaaactccttattgtaatttcggtttccaagccgaggacggccgtaaggaccctaaataccctaccgaaaagtaccgtacccttttaaaagtttaacgtttaaaacggggttttccctaaaaccggggtaccttaccggttacccgggggtaccccctaagtaacgacgtaacgtttccgaggggccggggtaccgtaggggtttaccggggtcaaacggggtccagtttacggttaacttttaccaactaaccgttaggaacttaaacgtaccggaaccggtaaaggggggttccggacgggtagtttagggaaaaggggttttccgttttagggggtttttaggggtttttaaacttcccggtttaacggacttaaggtttcgaaacgtaacgggttaaaccacgtacggttcggggtaaccccggttgggggtaccgttaccgggggaaaccgtaaacggggaccgttaaagggtacggaaactacggaaaacgtacgttcggaggtacgcgaccgacttacg

SEQ ID NO: 377914 - DNA, 678 bp, Homo sapiens
  misc_feature: GZ8MTXP02I7P90.51.86.H09.1.454.CMB.2.raw
  modified_base (200)..(200): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacngccgcctccatctcctgcaggtctagtcaaggcctctatatagtgataggaaactcctatgaattggttcagcagaggccaggccaatctaccgaagaccgtaccttaaattttagtaacggtttccgtaaacccggggtcttacggtaccggggttccccagtaacgacgtaatttccgaaggcgggtactaagggttcggggtcaacgggtccacgttgtaacctttcgactaacgtgtaaacttaactcggaaacggtagggggttggaaggtcgtagggaggttacgtttgggtttaggttttaacttacgtgacgtagtgacgaaaggtacctagacgtgggccgtacgggggttaccgtacgggacccggtaaaaggggtaaccgtaggggtaacgtaaaaacgttaccgaaaacgggtaacgtggttacggaacgtacggacccaacgtacgtttcctggtttacccttcg

SEQ ID NO: 377915 - DNA, 621 bp, Homo sapiens
  misc_feature: GZ8MTXP02INF5B.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgccccgtcacccttggacagccggcctcatctcctgcaggtctagtcaaggccctctatatagtgatggaaactacctactgaattggttcagtcagagccaggccaatctaccaagacgtaccttaaatttactaaggtttctaaaccggggtactcgtcggggtcccaagacagacttcagcggactaggtgggtcaggcactgatttcatactagataatcgacgaggggttaggaggtctaggaaggtattaggtttgggttttaaacttacgtgacttagtacgtacgtaaacggtacacgtacggtcggtaccggtaggggtaccggttacggaaccgaaaacgggggtacccgtaaaaggggttagaaaacgttaccgaaaacgtaaccgttggtacgtctacggctaaactagttcctggttacctttaac

SEQ ID NO: 377916 - DNA, 608 bp, Homo sapiens
  misc_feature: GZ8MTXP02I7J2Z.51.86.H09.1.454.CMB.2.raw
  modified_base (393)..(393): a, c, t, g, unknown or other
  modified_base (408)..(408): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacctggacacgccgcctccatctctgcaggtctagcaaggcctactatatagtagataggaaacacctattgaatttggttcagtcaggaggccagccaatctacaaagactacctaaatttagtaacgtttacgaaccggtatcgtcggggtacccagacagtattaccagcgcaggtggcaggacagtanactttcaacctatanaataaatcgaacgaagggttggaagcgtaggaggtactttggtttagggtttttaatacttgggaatagtagacgaaacgtaacacgtacgtcggtacggtacggtacggtacggaacggaaacgggaaacggtaaacggtaaacggtaaaacgaaacgtaaaacgaacgtacgtacggtacgtacgacgtaacgtaacg

SEQ ID NO: 377917 - DNA, 724 bp, Homo sapiens
  misc_feature: GZ8MTXP02IUXPV.51.86.H09.1.454.CMB.2.raw
  modified_base (212)..(212): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgttgtgctgactcagtctccactctccctgcccgtcaccttggacncgccgcctccatctctgcaggtctagtcaagcctctatatagtgataggaaactaccttattagtaatttcggttcagcaggacgccgaggccaatcctacaagtaccgtaccttaaatttagtaacggtttacgtaaccgggtactcggttccggggaccagacgagtacttcgacggtcgggtacgagggttcggggtaccacggggtcctacgtttgttaacgtttcaacgtacgtaggtaaattaaacgtcggtaaccgggtaagggggttacgggacgggtacgttaggtaagggttaagttttcggggttttaaggggtttttacgtaccgttggaccgtaagtaccggaacgtaaacgggtaacctacggtacggtacgggtcccggttacgggggtacccggttaccgggaaccggaaacggggtaaccgtaaacggggtaaacggtaaacgtaaaccggaaaacgtacggttacggtacggtaccgtacgaccgtaacttacg

SEQ ID NO: 377918 - DNA, 678 bp, Homo sapiens
  misc_feature: GZ8MTXP02FW3N5.51.86.H09.1.454.CMB.2.raw
  modified_base (213)..(213): a, c, t, g, unknown or other
  modified_base (428)..(428): a, c, t, g, unknown or other
  modified_base (493)..(493): a, c, t, g, unknown or other
  modified_base (502)..(502): a, c, t, g, unknown or other
  modified_base (504)..(504): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctgggctgctaatgctctgggtcccaggttccaggtggggatgttgtgctgactcagtctccactctctctcgcccgtcacccttggacncgccgcctccatcctctgcaggtctagtcgaacgtcctactatatagtagatagaaacctaccttacgttagtaatttcggttcagtcgaggacggaccgacggtaccctaactaccgtaccgaaacgtacccgttacctttaaagttttaacgttaaacggtttacgtaaaccgggtcttcccggtacggggtacccagaactagtaacttcgnggaccgtcgtaagggtcggtacgaggtccattcgtactttacaactactagaataacgcgaaggngggtacggngngtaggaggtagtttggtttagtttaatacgtagactagtacgtacgtaaacgtaccgacgtacggtcggtaccgtacggggttaccggtaccggaaacggtaaaccgggaaacggtaacggtaacggtaaaacgtaacgaaaacggtacggtaggcgtacgtaccgactaaccg

SEQ ID NO: 377919 - DNA, 657 bp, Homo sapiens
  misc_feature: GZ8MTXP02I8ZL3.51.86.H09.1.454.CMB.2.raw
  modified_base (252)..(252): a, c, t, g, unknown or other
  modified_base (289)..(289): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacncctacttgaattggttcagcagaggccaggccaatcnccaagacgcctaatttataaggtttctaaccgggactcgtggggtcccaagacagattccgagcggcaggtgggtaccagggctactggatttccgacactgataaatcggaagagggggtgaggtcgtaggaggtagtttacggtttagggttttaaattacgtgtacgtagttacggacctaaaggggttaccaccgtaacgtcggggtacccgtagggggtaacccgtttccggggaccgaaaacgggggtacccaaaagggggttacggaaaaacgttaccggaaaaacggtaaccgtttgggtacggggtcctacggaacctaacccgtattaccgtcggtttaccttctaacttttcccccg

SEQ ID NO: 377920 - DNA, 662 bp, Homo sapiens
  misc_feature: GZ8MTXP02HAZR5.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtgggatgttgtgctgactcagtctccactctccctgcccgtcacccttggacacgccggcctccatctctgcagtctagtcaacggtcctcctatatagtgatagaaactacctattagtaattggttcagtcagacggccaggcccaatccaccgaaacgacgtcccttaaatttagttaaacggtttacgtaaacccgggtactacgtcccggggtaccccaagaccgtagtaacttcgaaggccggacgtaacggtggggtacacgggctacgtagtactttaccaactactagtaagtaaacgttaccggagaaggggtcggtaaggagttagggaaaggttgtttacgggttttagggtttttatacgttaggatagtacgaacgtaagtaccacgtacggtggtacggtacgggtaccgtacgggaccgtaaagggaccgaaagggtaacgaaacgtaaacgaaacgtacgtacggtcgaccgtacgaccgtactacg

SEQ ID NO: 377921 - DNA, 505 bp, Homo sapiens
  misc_feature: GZ8MTXP02IB9G5.51.86.H09.1.454.CMB.2.raw
  modified_base (266)..(266): a, c, t, g, unknown or other
  modified_base (314)..(314): a, c, t, g, unknown or other
  modified_base (330)..(330): a, c, t, g, unknown or other
  modified_base (334)..(334): a, c, t, g, unknown or other
  modified_base (339)..(339): a, c, t, g, unknown or other
  modified_base (341)..(341): a, c, t, g, unknown or other
  modified_base (343)..(344): a, c, t, g, unknown or other
  modified_base (346)..(348): a, c, t, g, unknown or other
  modified_base (354)..(354): a, c, t, g, unknown or other
  modified_base (356)..(356): a, c, t, g, unknown or other
  modified_base (358)..(358): a, c, t, g, unknown or other
  modified_base (360)..(360): a, c, t, g, unknown or other
  modified_base (362)..(362): a, c, t, g, unknown or other
  modified_base (369)..(369): a, c, t, g, unknown or other
  modified_base (395)..(396): a, c, t, g, unknown or other
  modified_base (398)..(398): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtgggatgttgtgctgactcagtctcactctcctgccctcacctggacagccgctccatctctgcaggtctagtcaaggcctctatagagtgataggaaactcctatgaattgtcagcagngccagccaatctacaagacgacttaaattacgtaaggtttcaaacggntcgtggaccagacagntcancggangngnngnnnatacanananananagagagngagagagagtagtgttagttagtatnnanagacgagacgacgacgtcgtcgtacggtacgtacgacgaacggacgaagaacgaaagaacgaacgtacgtacgtacgaacgacgacgactacgtacgtacgtactcg

SEQ ID NO: 377922 - DNA, 635 bp, Homo sapiens
  misc_feature: GZ8MTXP02IB4LM.51.86.H09.1.454.CMB.2.raw
  modified_base (204)..(204): a, c, t, g, unknown or other
  modified_base (263)..(263): a, c, t, g, unknown or other
  modified_base (277)..(277): a, c, t, g, unknown or other
  modified_base (282)..(282): a, c, t, g, unknown or other
  modified_base (437)..(437): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatggttgtgctgactcagtctccactcctccctcgcccgtcacccgttgacncgccgcctccatcctcctgctaggtctagtcgaacgtcctactatatagtgatagaacnctatgtattgtcancgagngccagcaatctacaagacgtaccttaatttaagttaacgtttacgtaaaccggtactcggtacggggtacccagacagacttcgagcggacgtaggtcgggtcgacgtcacgtgtacttacactactcggtaaataacgtccggaagtagggggngaggtacgtagtagggttagtttggtttagtttaagttcgtaggtactaaggtcgaacgtaacggtactacgtcggtacgggtcggtacggtaccggtaaccggaacggtaaacggaaacggtaagggtaaacgtaaaccgaaacgtaaacgtacggtcggaacgtccgtcgaactactacgttcgtacttacgtacc

SEQ ID NO: 377923 - DNA, 618 bp, Homo sapiens
  misc_feature: GZ8MTXP02FGJWE.51.86.H09.1.454.CMB.2.raw
  modified_base (265)..(265): a, c, t, g, unknown or other
  modified_base (284)..(284): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctcctgcccgtcacccttggacagccggcctcatcctcctgcaggtctagtcaaggcctcatatagtgatggaaacncctactgaattggttcagnagaggccaggccaatctaccaagacgcctaaatttacgtaaaggtttcaaaccggggtctcgtccggggtccccagacagtaattcaaggtcgcaggtggtccaggcactgatttacactactgaactaatcgacgaaggggtgggaggtcgtaggagggtagttgggttttacggggttttaattacgttacgggagtacgtacgaacgtaacggtaacgtacgtacgtcggtaccggtacgggtacggtaccggaccggaaacgggaacggaaacgggtaacgtaaacgtaaaccgaaacgtaacgtacggtacggtacgtacgacactacg

SEQ ID NO: 377924 - DNA, 746 bp, Homo sapiens
  misc_feature: GZ8MTXP02G870K.51.86.H09.1.454.CMB.2.raw
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccgctccatctctgcaggtctagtcaggcctctatatgtgatgaaacactactgaattgttcagcagaggccaggccaatctaccaaagaccgtacccttaaatttaacgtaacggtttaccgtaaaccggggtaccttcgtaccgggggtacccccaagaccgtaagactttcgaacggtccggggactaacggggtcggggttacgaaggggtaccaacgttaacgggtacttttacaaaccctaaccgttacggtaaattaaaagtacccggaaacgtaacgggggttaggggacgggtaccgttagggaaaggggttaagtttagggttttagggtttttagttaacgttgggacctaagtcggacgtaaacggtaacaaccgtaacggtacggtcccgttacggggaccgggtttaccgggacccggtaaaacggggaacccgtaaacggggtaaacggtaaaaccgttaaaccggaaaaacgtaaaccgtaggttaccggggactaccggaaccctaaccgtaaccg

SEQ ID NO: 377925 - DNA, 719 bp, Homo sapiens
  misc_feature: GZ8MTXP02G2Z16.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacacgccgcctccactctcctgcaggtctagtcaagccctctatatagtgagtacggaaactacctacttgtaatttcggttacagtacaaggacggacccaacggaccctaaatccttaacccgaaaggtaacccgtaaccctttaaaagttttaacgttaaacgggttttacccgtaaacccggggtacctttccggtacggggtacccccaaggtacctaagtacgttaccgacggtccgggacgtaaggttcggggtacgaacgggtctaccgtgtaacgtttacaaccgtacgtacgtaattaaacgtacggacggtagggggttaggaaggtcgtagggaagggttagtttaggggtttaggggttttaaactggttaggaccgttaaggcgtaaccgggtaagtaacctacgtacgtcgggtacgtaggggtaccgtacggaccgtaaagggacctagggacgaaactacgaaaacgtctaggtacgaacgtcgacctacgatctcgtacttacc

SEQ ID NO: 377926 - DNA, 679 bp, Homo sapiens
  misc_feature: GZ8MTXP02J1NNN.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagcccggcctccatcctcctgcaggtctagtcaacggcctctatatagtgatagaaacacctatagtaattggttacagcaggacggccgaggaccaatccaccgaaagacctaccttaaaagtttacgttaaacgggtttacgaaacccggggtacttcggtaccggggtaccccaaggaactacgtacgttacgagggtcggacgtagggttcgggtcgaggctacgtgtactttaccactactagtaaactaagtaccggtacggaggggtgggacgtgtaggtagggttagtttgggtttacggttttaatacgtggtactagtacgtacgtaaagggtacctaacggtcgacgggtcgtaggggtaccgttacggaccgtaaacggggtaaccgaagggtaaacggtaaacgtacggtaaaacgtaacggttcggaggtaaccgtacgtaccgactagtcttacggttcttaccg

SEQ ID NO: 377927 - DNA, 592 bp, Homo sapiens
  misc_feature: GZ8MTXP02FMODI.51.86.H09.1.454.CMB.2.raw
  modified_base (295)..(295): a, c, t, g, unknown or other
  modified_base (335)..(335): a, c, t, g, unknown or other
  modified_base (338)..(338): a, c, t, g, unknown or other
  modified_base (384)..(384): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcaccctggacagccgcctccatctcctgcaggtctagtcaaggcctctatatagtgataggaaacacctattgaattggttcagcagacggcaggccaatctacaagacncttaaatttataagtttcaaccggactgtgggtcccaganagntcagcgcagtggtcaggcactgattacacactgaataatcgaacgnggggtgaggcgtaggaggtagttggtttgggttttaattacgtgactagtagacgtaaaggtaccactacgtaggtccggtggggtaccggttacgggaccgaaacggggaaaccgtaaagggtacggtaaaataacgaaaacggtaaacgtggttacggacgtacgaaccgtaacgaacgttcgttcgtcttacctacgtttccccg

SEQ ID NO: 377928 - DNA, 566 bp, Homo sapiens
  misc_feature: GZ8MTXP02J1U8H.51.86.H09.1.454.CMB.2.raw
  modified_base (275)..(275): a, c, t, g, unknown or other
  modified_base (288)..(288): a, c, t, g, unknown or other
  modified_base (293)..(293): a, c, t, g, unknown or other
  modified_base (302)..(302): a, c, t, g, unknown or other
  modified_base (308)..(308): a, c, t, g, unknown or other
  modified_base (336)..(336): a, c, t, g, unknown or other
  modified_base (341)..(341): a, c, t, g, unknown or other
  modified_base (343)..(343): a, c, t, g, unknown or other
  modified_base (348)..(348): a, c, t, g, unknown or other
  modified_base (403)..(403): a, c, t, g, unknown or other
  modified_base (430)..(430): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccagtggggatgttgtgctgactcagtctccactcctccctgccccgtctacccgttggaccacgcccggcctccatcctcctgcaggtctagtcaagtccctctatatagtgatgaaacnctatgattgttcngcagngcagcatcncagacnctattatagttcacggctgccggtccanacagntnagcgnaggtgcagcactgtactttacgactactgtaatagtcggacgtaggggtgaacgngtggaagtgtttggttaggtttactgngtacgtagtgtacgaaggtacacgtacgtcggaccggttcggggtacgtaccggacgggtaaacggaccggtaagggaaacggtaaaccgtaacgaaaaccggtacttgggacgtaccgtcggaaaccctacgtcg

SEQ ID NO: 377929 - DNA, 697 bp, Homo sapiens
  misc_feature: GZ8MTXP02F50FZ.51.86.H09.1.454.CMB.2.raw
  modified_base (200)..(200): a, c, t, g, unknown or other
  modified_base (419)..(419): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtgggatgttgtgctgactcagtctccactctccctgcccgtcacccttggacncgccggcctccatcctcctgcaggtctagtcaacggcctctatatagtgatacggaaactaccttacttagtaagtttggttcagtcaagacggacccaggacctaactcctaccgaaagtaccgttaaccttaaaagttttaacgttaacggttttaccgtaaacccgggtcgttaccggtcggggtaccccaagtaactacgtattccgaggccggngtaggttcggggtaccgggactagttcgtactttcaactctagtataagtccggagtggggacgaggtgtagggtagttagtttggtttacggttttaatcgtgactagcgaacggttaaacggtactacgtacgttcgggtccgtacggggtaccgttaccgggaacgtaaaacgggggtacgtaaaggtaaacgtaaaacgtacggtaaaaccgagttacgggttacggaacgttacggaccacggttacctttcggttaaccgttccgtttaccg

SEQ ID NO: 377930 - DNA, 744 bp, Homo sapiens
  misc_feature: GZ8MTXP02JEXJ1.51.86.H09.1.454.CMB.2.raw
  modified_base (400)..(400): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcaccgttggacacgccgcctcatctctgcgtaggtctagtcaacggtcctactatagtagtgatacggaaactaccttatgtaatttggttcagtcgaggacgccaggacctatcctacgaagtacgtacctttaaagttttacgtaacggtttaccgtaaaccgggtcttccggtcggggtaccccaggtaccagtactcgagtcggtanagggttggcgaggctagtagtacgtttaccaagacttagtaataaagtccggaaggtaggggtaggagtcgttagggaaggttagtttagggtttaggttttaactaccggtggtaccgtaagttacggtaacggtaaacgtaccgaaccgttcgggtcgggttcggttacggggtaacccggttaccggggaaaccgggttaaaacggggaaccgggttaaagggtaaaacgggtaaaacgtaaaccccggttaaaagggtaaacccggttggttaacggggccttaaaacggggtacccctaaaccggttactttccccggttttacgtttacccttaaccg

SEQ ID NO: 377931 - DNA, 769 bp, Homo sapiens
  misc_feature: GZ8MTXP02FKNHO.51.86.H09.1.454.CMB.2.raw
  modified_base (275)..(275): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgataggaacactacttgaattggttacagnagagccaggccaaatctaccaagaccgtaccttaaattttacgtaaggtttaccgtaaaccgggtacttccgtcgggggtacccaaggtaccgaagtatttaccgaggaccggggtacgtaaggttcggggtaccacgggtacctaaacgttacggtaaactttttccaaacgtaaccgttaggtaaacttaaacgttaccgggtaaccggtaaggggggtttaggggaaacggggtaccgttaggggtaaaggggttaggtttaggggttttaggggttttttaaagtttaccgtggtacgtagtacggtaacgtaaacggttaacgaccgttacgtcgggtaccggttaggggtaaccggtttccgggaacccgggtaaaacggggtaacccgaaagggggttaacggtaaaacgttaaccgtaaaaccggtaaaccgttgggtaacggcgttaccgacgtacccgtattccggttacgttcctttaacccg

SEQ ID NO: 377932 - DNA, 603 bp, Homo sapiens
  misc_feature: GZ8MTXP02I6XWZ.51.86.H09.1.454.CMB.2.raw
  modified_base (199)..(199): a, c, t, g, unknown or other
  modified_base (443)..(443): a, c, t, g, unknown or other
  modified_base (480)..(480): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtgggatgttgtgctgactcagtctccactctccctgcccgtcacccttggacngccggcctcatctctgcaggtctagtcaaggcctctatatagtgatggaaacacctacttgaattggtttcagcagaggccaggcctaatctaccaaagaccgtacccttaaattttactaaaggttttcctaaaccggggtacttcgtcggggtaccccaggactacggattccgagccggcaggtgggtcagggtcacgttgactttcaactctagattaaactcgacgaggggtagacggngtagagggattcggttagggttttatacgttgactangtacgaagtacacgtacgtggcgtgggtacgtccgggactaaacggggaccaaagggtacggtaaaagttaccgaaaacggaccttggacggaacgtgaccacgtaatcgtacgttactttac

SEQ ID NO: 377933 - DNA, 699 bp, Homo sapiens
  misc_feature: GZ8MTXP02GHEHA.51.86.H09.1.454.CMB.2.raw
  modified_base (252)..(252): a, c, t, g, unknown or other
  modified_base (679)..(679): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccaggtggggatgttgtgctgactcagtctccactctccctgcccgtcacccgttggacacgccggcctccatcctcctgcaggtctagtcaacggcctactatatagtnatacggaaactactattgaattggttcagcagagccaggaccatctacaagacgtacctaatttagtaacggtttaccgaaccgggtcttcggtacgggtacccaaggtacacgtagttacgagcggacgtaggtcgggtcgacggtactacgttatactttacaccgtaacgtagtaaattaacgtacgggaaccggtagggggttacgacgggtccggttaggtaaagggtttagtttacgggttttaaggggtttttaaacttacgtaggttacgtaagttacgggaacgttaaacggtaccgacgttacgggttcggtaacccggttcgggggtaccgttacggggaaccgaaacggggtaccgtaaagggtacgaaaacggttacgaaaacgttcggtgtaccggtaacgtacgactacctntacgtttcggtactttaccg

SEQ ID NO: 377934 - DNA, 646 bp, Homo sapiens
  misc_feature: GZ8MTXP02HSL8R.51.86.H09.1.454.CMB.2.raw
  modified_base (260)..(260): a, c, t, g, unknown or other
tcagcgatcgtatacacgaccggtgctcgatttagtgctatagacttgggtttggggacccttgccttgactgatcaggactcctcagttcaccttctcacaatgaggctcccctgctcagctcctggggctgctaatgctcgtgggtcccaggttccaggtggggatgttgtgctgactcagtctccactccctcctgccctcaccttgacacgccgcctccatctctgcagtctagtcaacgccttactatataggtnatacgaaactccttattagaattggttcagcagacgccaggaccaactcaccaagtactacttaatttagtacgttacgtaccggactcggtccgggacccagacagtattcgaggtcgacgaggttcgggaccaggctaatgtacttacactattagattaaacgtcggaacggtagggggtacgaggagttagggtaaagttgttttacggttttagggtttttaacttcgggtatgtaagttgtaaacgaaggtaccaacgtacggtacgggccgttaacgggggtaccgttacggaaaccggaacggggtaaacccgaagggttaggaaaacccttaggaaaaccggtaagtacggtcggaccctagacccgttaacgtacg

SEQ ID NO: 377935 - DNA, 601 bp, Homo sapiens
  misc_feature: GZ8MTXP02ICRNF.51.86.H09.1.454.CMB.2.raw
  modified_base (497)..(497): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctcccacttctccctgcccgtcacccttggacacgccgcctcatcctctgcaggtctagtcagcctctatagtagtgataggaactactactgaattcggttacagcgagacgaccacggaccaatcctacgaagaccgtaccttaaattttacgtaacggtttaccgaaccggtctcggtacggggtccccagacagattaccgagtcggactaggttcggcaggcacgttgactttcgatacagtataatcgaagacgggtggacgcgttaggaggtatttacggttgggttttaatcgttgatagtcgaagtaggacctagtcgnggtccgttggacgttacgggaccaagggacgaaggtaacggaaactaacggaaaacgtacgttaggacgtcgtacggaacctacgtatcggttacttccgtacg

SEQ ID NO: 377936 - DNA, 759 bp, Homo sapiens
  misc_feature: GZ8MTXP02F7C4H.51.86.H09.1.454.CMB.2.raw
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaatttggttcagcagacggtccaggccaaatcgtaccaagtacgaccttaaagtttacgaaaggttttccaaaccggggcttcgtaggggtccccaaggtacctaggtactttcgaaacggtcgggaccaaggtttggggtacgaacggcctaaaccttggaactttttacaacgaaccttaggaactttaaaagtcccgaaaggttaaaagggggtacggtaaggtccgtaggtaaggtaaggtttagggttttacgggtttttaacgtttaacgttacggtacgtaacgtacgtaacgtaaacggtaaaccgtaaccgtaacggtaccggtaccggttacggggttaaccgggttaccgggtaaccgggtaaaccggggtaaaccgggtaaaacgggtaaaacgggtaaaacgtaaacggtaaaacgtaaaacgtaacggtacggtaaccggtacgtaaccgtaccgtaacgtacgttacgtttacgtttaccg

SEQ ID NO: 377937 - DNA, 600 bp, Homo sapiens
  misc_feature: GZ8MTXP02HRMUS.51.86.H09.1.454.CMB.2.raw
  modified_base (195)..(195): a, c, t, g, unknown or other
  modified_base (270)..(270): a, c, t, g, unknown or other
  modified_base (273)..(273): a, c, t, g, unknown or other
  modified_base (317)..(317): a, c, t, g, unknown or other
  modified_base (322)..(322): a, c, t, g, unknown or other
  modified_base (342)..(342): a, c, t, g, unknown or other
  modified_base (380)..(380): a, c, t, g, unknown or other
  modified_base (399)..(399): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccaggtggggatgttgtgctgactcagtctccactctcctgcccgtcacctggacngccgcctcatctctgcaggtctagtcaaggtcctactatagtagtgataggaaacactactgtaattggttcagnagngcagcaatcacaagacgtcctaaattataaggtttacaaccggnttcgngggtaccagacagactcagngcagtggacaggctaatgtattcactatagaactaaanccgaagagggtagacgggngtagtaggtagttggtttaggtttagttacgtagtagtagtacgtacgaacggtacgtacgtacgtacggtccggtacggtacggtaccggacggaaacggaaacggtaaacggtaacggtaaacgtaaacgtaaacgtaaacgtacgtacgtacgacgtaaccgtaccgtacgtacgttacgttacttacctacgtaccg

SEQ ID NO: 377938 - DNA, 650 bp, Homo sapiens
  misc_feature: GZ8MTXP02JVM8L.51.86.H09.1.454.CMB.2.raw
  modified_base (415)..(415): a, c, t, g, unknown or other
  modified_base (469)..(469): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctcgtgggtcccaggttccagtggggatgttgtgctgactcagtcctccactctccctgcccgtcacccttggacacgcccggcctccactctcctgcaggtctagtcaacggtcctactatactagtgatacggaaactacctacttgtaatttggttcagtcaggagaccgaggccaacgtctaccaagacgtaccttaaatttagtaacggtttacgtaaacgggacttcggtcggggtacccagactagacttcgagcggcgaggtcgggtanaggctaatgtactttacgactacgtgaaataacgtcgacggagggtacggaggngtaggtaggtagtttggtttaggtttattacgtgtagagtggacgtaacggtactacgtacgtcggtacccggtaggggtacccggttaccgggaaccgaaacggggtaaccgtaagggttaaacgaaacgttaacgaaaaccggtacgttaggggtacgtcgtaccgaccgtacttaacg

SEQ ID NO: 377939 - DNA, 577 bp, Homo sapiens
  misc_feature: GZ8MTXP02JUS8R.51.86.H09.1.454.CMB.2.raw
  modified_base (253)..(253): a, c, t, g, unknown or other
  modified_base (270)..(270): a, c, t, g, unknown or other
  modified_base (276)..(276): a, c, t, g, unknown or other
  modified_base (287)..(287): a, c, t, g, unknown or other
  modified_base (293)..(293): a, c, t, g, unknown or other
  modified_base (326)..(326): a, c, t, g, unknown or other
  modified_base (380)..(380): a, c, t, g, unknown or other
  modified_base (457)..(457): a, c, t, g, unknown or other
tcagcgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactcctccctgcccgtcacccttggacagccgcctccatcctcctgcaggtctagtcaaggcctctatatagtgatagaaacnccttattgaattggttnagcagngccagcaatcncaagcnctaattatagttcaacggctgtcgggccagacngatccagcgcaggtcggcagccactgtactttcactactgaactaaatcgaagnggggtgagctagaggtagtttggtttcggtttaatcgtagcgttaagcgtacgaaagttcaacgtcgttacggccgngggtaccgttaccggacgaaagggggaccttaaggaacgggaaactacccggtaaaagttacgtttcggggaccttaggacctaacctgtccgttctccttacaccttacccgttccccg

SEQ ID NO: 377940 - DNA, 514 bp, Homo sapiens
  misc_feature: GZ8MTXP02FX9PD.51.86.H09.1.454.CMB.2.raw
  modified_base (185)..(185): a, c, t, g, unknown or other
  modified_base (304)..(304): a, c, t, g, unknown or other
  modified_base (418)..(418): a, c, t, g, unknown or other
  modified_base (489)..(489): a, c, t, g, unknown or other
  modified_base (501)..(501): a, c, t, g, unknown or other
tcagcgatcgtatacacgaccggtgctcgatttagtgctatagacttgggtttggggatcaggactcctcagttcaccttctcacaatgaggctccctgctcagctcctggggctgctaatgctctgggtcccaggttccagtggggatgttgtgctgactcagtctccactctccctgcccgtnacccttggacagccggctccatctcctgcaggtctagtcaggcctctatatagtgatggaacacctactgaattggttcagcagaggccaggcccaatctccaagacgtcctaatttanaacggttttctaaaccggggactctggggttaccccagacagagttccccagcgcagtggtccaggcactgatttcacactgataatcgacaggtgagctgagatgtggtttanactgcatgacaggtacacattggacctggggacttcgggactaggggaccaaggtcgaaatcaaaggcagnggcctagcacancctgtctcatccg

SEQ ID NO: 377941 - DNA, 588 bp, Homo sapiens
  misc_feature: GZ8MTXP02HHVBS.51.86.H09.1.454.CMB.2.raw
  modified_base (199)..(199): a, c, t, g, unknown or other
  modified_base (253)..(253): a, c, t, g, unknown or other
  modified_base (258)..(258): a, c, t, g, unknown or other
  modified_base (412)..(412): a, c, t, g, unknown or other
tcagcgatcgtatacacgaccggtgctcgatttagtgctatagacttgggtttggggactgatcaggactcctcagttcaccttctcacaatgaggctccctgctcagctcctggggctgctaatgctctgggtcccaggttccagtgggatgttgtgctgactcagtctccactctccctgcccgtcacccttggacngccggcctccatctcctgcaggtctagtcaaggcctctatatagtgatggaacnctatnattggttcagcagacggcagtccatctccaagaccgtactaattttagtaacggtttcctaaaccggggcttacgtcggggtaccccaaggtacacggtacttcgagcggtacaggtgggtcaggcactgtattcgaactgtagattaagcgangggtgaggctaggagtagttgtttagggtttaactcgtgtctagttagacgtacgttacgaccgtaagtcggtcggttacgggacggttcggtacccggaaacgggaccggtaacggtaggaaacgtaacgaaacgaacgtcgttagcgtacgtacacctactctcgtcgtttccg

SEQ ID NO: 377942 - DNA, 917 bp, Homo sapiens
  misc_feature: GZ8MTXP02JIMWU.51.86.H09.1.454.CMB.2.raw
tcagcgatcgtatacacgaccggtgctcgatttagtgctatagacttgggtttggggactgatcaggactcctcagttcaccttctcacaatgaggctccctgctcagcctcctggggctgctaatgctcgtcgggtcccaggttccaggtggggatgttgtgctgactcacgtcctccacctcctccctcgcccgtcctacccgttggaccacgcccggtcctcctacttcctccgtgcgtacggttctacgtacaacggtcctactatagtagtgatacgaaacacttactagtaagtttgttacagacgacggacggccgacgaccaatacctacgaaagacccgttaacttaaagttttaacgttaaacggtttacccgaacccgggtacttccggtccggggtaaccaggtaactacggtacttacgacggcggtacgtaacggggttggtccggaagtcgttaccgttaggttacctttaccaaacgtacccttaagtaaacgttaacgtacggggaaaaccggggttaggggtagggggttacccgtaacgggttacgggggttaaaagggtttgggtttttaaaggggttttttaccgggtttttaaaagttcccgggttagggtaaaccccggtttaaggtacccgggttaaacccggtaaaaggtttaaacccccgtaaacggttcccggggttaacccggggtacccgggggtttaacgggggttaaccccggggtttaacgggggaaaccccgggtaaaaaccgggggtaaccgggtaaaacgggggttaaaacccggtaaaagtaaaccggtaaaaccggttaacgggtccgggtttaaaacgcccggtttaacaaaacccgttccggtaacttttacccggttaccgtttaacccgtttcccg

SEQ ID NO: 377943 - DNA, 735 bp, Homo sapiens
  misc_feature: GZ8MTXP02HXMH9.51.86.H09.1.454.CMB.2.raw
  modified_base (266)..(266): a, c, t, g, unknown or other
tcagcgatcgtatacacgaccggtgctcgatttagtgctatagacttgggtttggggacccttgccttgactgatcaggactcctcagttcaccttctcacaatgaggctccctgctcagctcctggggctgctaatgctctgggtcccaggttccaggtggggatgtgtgctgactcagtctccactctccctgcccgtctacccttggacacgccgacctcactctcctgcaggttctaggtcaacggtcctactatataggtnacgtaggaaactaccgttattggtaactttgggtttccagtcgagtacggccacggaccactacctacgaaagtaaccgtccttaaagtttttacgtaaagggttttacctaaaccggggtcttaccggtacggggtaccccctaaggtacggtacgtaagtttcccggacgggttcgggaccgttaaacgggttcgggtaccgtaacggggtcctaaacgttcggtaatttaccgaaaccctgtacgtaaataacgttacggacggtttaagggggtggacggtcgtagggttaggttgtttacgggtttagtttacgttagtgtagtagtcggtaacgtaacgtcgtacgtcgtacgggtcggtacggtacggtaccggaaccgtacggggtaaaccgtaaggggtaacctaaaacgtaacgaaaacggttcgtacgggtaccgtacgtaccgtaccgtaccgttcg

SEQ ID NO: 377944 - DNA, 523 bp, Homo sapiens
  misc_feature: GZ8MTXP01BWVYT.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaccttcagtagctatagcatgaactgggtccgccaggctccgaggggaggggctggagtgggtctcatccattagtcgtagtagtagttaacataatactacgcagactcagtgagggccgattcacatctaccagagacaacgccaaagaactcactgtatctgacaaatgaacagcctgagagccgaaggacacggcttgtgtattacgttgttgcgtagtaaggtttttcggtttggagtgccgtaag

SEQ ID NO: 377945 - DNA, 578 bp, Homo sapiens
  misc_feature: GZ8MTXP01CWSSU.39.14.B03.1.454.CMB.2.raw
  modified_base (305)..(305): a, c, t, g, unknown or other
  modified_base (404)..(404): a, c, t, g, unknown or other
  modified_base (409)..(409): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccnccaggctccgaggggaaggggctgggagtgggtctcatccattagtcgtagtagtagttaacataatactacgcagactcagtgagggcattcacatcncaganacaacgcaagaactcacgtgtatctagacaaatcgaaacagcctggaagacggcccggaaagggccgaacggggtcttaggttacgttaagttaccgttggttacggtaacgggttaaggtttcggtttttttcggggtttttaggggacgtttcggcccgttttaagg

SEQ ID NO: 377946 - DNA, 539 bp, Homo sapiens
  misc_feature: GZ8MTXP01A38BL.39.14.B03.1.454.CMB.2.raw
  modified_base (252)..(252): a, c, t, g, unknown or other
  modified_base (261)..(261): a, c, t, g, unknown or other
  modified_base (297)..(297): a, c, t, g, unknown or other
  modified_base (530)..(530): a, c, t, g, unknown or other
  modified_base (532)..(532): a, c, t, g, unknown or other
  modified_base (534)..(535): a, c, t, g, unknown or other
  modified_base (537)..(537): a, c, t, g, unknown or other
  modified_base (539)..(539): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctcctgcactggaagcagcagtgacgttggtgttatactatgtctcnggtaccaanagcacccaggacaaacgcccccaaatcatgatttangagctgaggacgaggctgattatactgcagctcaatataacaagcagctagctacttcttgtgtattcggcggaggacaagctgaccgtcgtagtcagccccgaaggggcctaccggtcccccgtcggtacctaccgttccgttccgttccccggccccttcccgtacctaaccgttacggttcgccgacgttcggacggccgggtcgttcgggcgaaacgggcgactaaggngngnngngn

SEQ ID NO: 377947 - DNA, 559 bp, Homo sapiens
  misc_feature: GZ8MTXP01D59IY.39.14.B03.1.454.CMB.2.raw
  modified_base (265)..(265): a, c, t, g, unknown or other
  modified_base (305)..(305): a, c, t, g, unknown or other
  modified_base (378)..(378): a, c, t, g, unknown or other
  modified_base (484)..(484): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctntggattcaccttcagtagctatagcatgaacgtgggtccncgaggctcgaggggagggctggagtggtctcatcattagtcgtagtagtagtaacataatactacgcagactnagtgaaggcatcacatctaccagacgacaacgccaaagactcacgtgtatcctagacaaaagtcgaaactacgcctagacgacgcccggaaggtccaccggggttnttaggtagttacttacgttggttacggtaaggttaggttttaacggtttttcgggttggacgtcgttaacgtaag

SEQ ID NO: 377948 - DNA, 601 bp, Homo sapiens
  misc_feature: GZ8MTXP01AJL6H.39.14.B03.1.454.CMB.2.raw
  modified_base (586)..(586): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgaacgtcgggtcccgccgaggcctaccggagggggaacgggggcgtggggaggtggggtctacgactcctagtttacggtcgtaggttaagtagttaaacattaatactacgcagactcgagtagaacgggcctagttaccaccatcctaccgagacgaaccaacgaccaaagaacctacacgtgtactctacgacaaatcgaacacgtctagagacgcccggaagaccgacggtcgttgtagttaattcgttggttcggtaacggttagttaacgggttttttgggtttagggngttcgttccgttaag

SEQ ID NO: 377949 - DNA, 516 bp, Homo sapiens
  misc_feature: GZ8MTXP01D30PZ.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaagcctggggggtccctgagactctcctgtgcagcctctggattcaccttcagtagctatagcatgaaactgggtccgcaggctccgaggggaggggctggagtggtctcatccattagtcgtagtagtagttaacataatactacgcagactcagtgaagggccattcacatctaccagagacaacgacaagaactcactgtatctgacaaatgaacagcctagagacgccgaagcacggcttgtagtattacgttgttgcgtagtgttttcggtttggagttgcttaag

SEQ ID NO: 377950 - DNA, 524 bp, Homo sapiens
  misc_feature: GZ8MTXP01EZ7CS.39.14.B03.1.454.CMB.2.raw
  modified_base (305)..(305): a, c, t, g, unknown or other
  modified_base (412)..(412): a, c, t, g, unknown or other
  modified_base (491)..(491): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccnccgaggctaccgaggggaggggctgggagtgggtctcatccattagtcgtagtagtagtaacataatactacgcagactcagtgagggccattcacatctaccaganacaacgacaaagactcacgtgtatctagacaaatgaacagcctagagacgcgaagcacggcttgtgtacttgttgttgngtagttggttttcgggtttgagtcgttcgtaag

SEQ ID NO: 377951 - DNA, 547 bp, Homo sapiens
  misc_feature: GZ8MTXP01ETAZ1.39.14.B03.1.454.CMB.2.raw
  modified_base (304)..(304): a, c, t, g, unknown or other
  modified_base (307)..(307): a, c, t, g, unknown or other
  modified_base (336)..(336): a, c, t, g, unknown or other
  modified_base (365)..(365): a, c, t, g, unknown or other
  modified_base (428)..(428): a, c, t, g, unknown or other
  modified_base (497)..(497): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctatccatgcacgtggtccncgngctccgaggggaagggctgggagtggtcncatcccattagtagtagttctaagttacnttatctatgctacgcctgagtgaagggccattcactatctccagacgacgacgtccaaagacnctaggttcgttactgaaccaaagtcgaacacgcctaggagacgcccggaagaccacggcttacgtttanacgttgcgaaggagaaggtagggtaacttaacggtaaccttaacgtaacg

SEQ ID NO: 377952 - DNA, 580 bp, Homo sapiens
  misc_feature: GZ8MTXP01E0PIO.39.14.B03.1.454.CMB.2.raw
  modified_base (306)..(306): a, c, t, g, unknown or other
  modified_base (456)..(456): a, c, t, g, unknown or other
  modified_base (477)..(477): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaacgtgggtccnccgaggctaccgaggggaaggggctgggagtgggtctacgatcctattaggtcgtagtagtagttaacataatactacgcagactcgagtggaaggccgattcactatctaccgagacgaacaacgcaaagaacctcaacgttgttaacncgtacgaacaaagtcgaaacnggcctaggacgacggccgaaggtacacggcttgtagttaacttcgttggttagtccgtaggtttaaccgggttttttgggtttaggagttcgttcccgttaag

SEQ ID NO: 377953 - DNA, 525 bp, Homo sapiens
  misc_feature: GZ8MTXP01C77E5.39.14.B03.1.454.CMB.2.raw
  modified_base (305)..(305): a, c, t, g, unknown or other
  modified_base (403)..(403): a, c, t, g, unknown or other
  modified_base (457)..(457): a, c, t, g, unknown or other
  modified_base (474)..(474): a, c, t, g, unknown or other
  modified_base (477)..(477): a, c, t, g, unknown or other
  modified_base (486)..(486): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccncaggctaccgaggggaagggctggagtgggtctcgatcctattagtcgtagtagtagttaaacataatactacgcagactcagtgaagggcatcaccntcacagagacaacgaccaagaactcactgtatctgacaaatgaacagcctgagngaccgaaggacacggcngtntaattacgngttgcgtaagttgtttttcgggtttggattcgccgtaag

SEQ ID NO: 377954 - DNA, 533 bp, Homo sapiens
  misc_feature: GZ8MTXP01A8LCB.39.14.B03.1.454.CMB.2.raw
  modified_base (308)..(308): a, c, t, g, unknown or other
  modified_base (372)..(372): a, c, t, g, unknown or other
  modified_base (432)..(432): a, c, t, g, unknown or other
  modified_base (482)..(482): a, c, t, g, unknown or other
  modified_base (498)..(498): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaacgtggggtcccnccaggctccgagggggaaggggctggagtgggtctcatccattagtcgtagtagtagtaacatntactacgcagactcagtagaacgggccattaccacattccaccagacgacaacgccaaanactcactgtatccagaacaaatgaacagcctagagacgccggaaggaccnggcttgtgtattacgngttgcgtagttcggttttggttgacgttgcttaag

SEQ ID NO: 377955 - DNA, 701 bp, Homo sapiens
  misc_feature: GZ8MTXP01BGW8G.39.14.B03.1.454.CMB.2.raw
  modified_base (264)..(264): a, c, t, g, unknown or other
  modified_base (297)..(297): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctcctgcacgtggaaccagcagtgtacgttggtgttaatactatgtctcttgaccaantcaccagaacaaacgtcccaaatgatgtattangagtcacgtaaacgcctagaggtttctaatcgtcttcctctggcctaccaagtcctacgggcaaaccgtacccggtccccttcccgtacgtaccacgttcccttcgtcggggtacccttccgaagggtccgttaagggaacgggtaccggtaacgggtcccttaccgttacctttaagtttaacgttcggtacctaaggtccctacctaagttaaacttaaccgaaagtccctaaattttactccgttaaccggtttgggggttccggtttaaccgggggaccggggttaaaccggggtaaccccggttaaccgtccgggttaacccgttacggtttacggacccgaaccggtaccccgaacgggtcccctcccggttaccccccgttcggttccctaaccccg

SEQ ID NO: 377956 - DNA, 615 bp, Homo sapiens
  misc_feature: GZ8MTXP01CCH9G.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagccgtgggggtccctgagactctcctgtgcagcctctggattcaccttcagtagctatagcatgaacgtgggtcccgcgaggcctccggagggggaaggggcgtgggaggtggggtctacactcctagttaggtcgtagtaagtagttaaacattaatactaacgcagactcgagtaggaacgggcctattccacctatcctaccgagacgaccaacgaccaaagtacctcacgttagtactcgtacgaactaaaagtcgaaacacgcccgtaggacgaacggcccggaaagggaccacgggtcttaggttacgttaacttacgttggttcgtaacggttaggtttaaggttttttcgggtttaggacgtttcgaaccgttaagg

SEQ ID NO: 377957 - DNA, 553 bp, Homo sapiens
  misc_feature: GZ8MTXP01E14IG.39.14.B03.1.454.CMB.2.raw
  modified_base (540)..(540): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccgccaggctcgaggggaaggggcgtggagtgggtctcatccattagtcgtagtagtagtaacataatactacgcagactcagtgagggccattcacatctcagacacaacgcaaagactcagtgtatctagacaaatcgaaactagcctaggacgacggcccgaagggaaccacgggcttggtagttaacttacgttggttacgtcggtaggtttaaggttttttcgggttttaggngttcgccgttaag

SEQ ID NO: 377958 - DNA, 644 bp, Homo sapiens
  misc_feature: GZ8MTXP01EINWV.39.14.B03.1.454.CMB.2.raw
  modified_base (260)..(260): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtcgggggtcctgagactctctgtgcngcctgtggacttcacttcagtgctatagcagtgaacgtcgggtcccgcgacggccgtacggagggggacgggcgtaggagtggtctcatcctagttaggtacgtaagtagttagttaaacaatttaactacgtaacgcagtactacgagtagggaaacgggtcctaattccaactactctaaccgagaacgaaccaaaccgacctaaataacctacgtaactgtaacttcaacgaacaaagacgaacgaacgaccgtagacgaacgaccggaacggaacgaccggtacgttacgttacgttaacgttaacgttcggttacggtaagggttaggtttaacgggttttttacgggttttgggttaggttaacgttcgtttaaccgg

SEQ ID NO: 377959 - DNA, 552 bp, Homo sapiens
  misc_feature: GZ8MTXP01BG9YV.39.14.B03.1.454.CMB.2.raw
  modified_base (412)..(412): a, c, t, g, unknown or other
  modified_base (445)..(445): a, c, t, g, unknown or other
  modified_base (460)..(460): a, c, t, g, unknown or other
  modified_base (470)..(470): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctctgtgcagcctctggattcgccttcagcagctattccatgcacgtcgggtccgccaggcctccgaggggaagggggctgggagtgggtctcatcccattagtagtagttctaaagttacaattatcttatgcagctcagtgaagggcattcaccatccncagacacgacgtccaaagactcagttcgtttcngacaaagtgaaaccngtcctgacgngcgaggacacggttcttacgtttattacgttgttcgaacggagtaacggaacgggtacttaacgggtcttaacgttaaccgg

SEQ ID NO: 377960 - DNA, 604 bp, Homo sapiens
  misc_feature: GZ8MTXP01AJREN.39.14.B03.1.454.CMB.2.raw
  modified_base (395)..(395): a, c, t, g, unknown or other
  modified_base (467)..(467): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtcgtgggggaggcctggtcaagccgtggggggtccctgagactctcctgtgcagcctcgtggattcaccttcagtagctatagcatcgaacgtcggggtcccgccgaggcctaccggagggggagggggcgtgggaggtgggtctcatcctagttagtcgtagtagtagttaacataatactacgnagactcgagtagaacgggctattcacatcacagacgacaacgccaaagactcaactgtatctagaactaaancgaaacacgcccgtaggaacgacggcccggaaggaccgacgggtcgttaggttagttaacgtttacgttggttacgggtcggttaaggtttaacgggttttttacggggttttcgggagtttcggaacccttaaggg

SEQ ID NO: 377961 - DNA, 561 bp, Homo sapiens
  misc_feature: GZ8MTXP01EW0Y3.39.14.B03.1.454.CMB.2.raw
  modified_base (380)..(380): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactgaggctccgctgggttttccttgttgctattttagaaggtgtccagtgtgaggtgcagctggtggagtcgtgggggaggcctggtcaagccgtgggggtccctgagactctcctgtgcagcctcgtggatcaccttcagtagctatagcatgacgtggccgcaggctccgaggggaagggcgtggagtggtctcatcccattagtcgtagtagtaagttacaatatactacgcagactnagtagaacggccgtacttcaccatctaccagacgacaaaccgacaaacgaacctacgacttaggggtactcgtagacaaatacgaaacacgacctaggacgaggaaccgaggacgacgttcgtgtgttagttacttggtcgtagtaaggtttgggttttcggttttaggtcgttgtaaccg

SEQ ID NO: 377962 - DNA, 585 bp, Homo sapiens
  misc_feature: GZ8MTXP01AOAH4.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaacgtgggtcccgcaggctccgagggggaggggctgggagtgggtctcgatcattggtcgtagtagtagttaacataatactacgcagactcgagtgaagggccattcaacatctaccagacacaacgccaaagactcacgttagtactactagaacaaagtgaacagcctgggaagacggacccggaaggaccacggggtacttggttagttaacgtttacgttggttacggtggttaaggtttaaccgggttttttcgggttttagggacgtttcggttccgtttaagg

SEQ ID NO: 377963 - DNA, 719 bp, Homo sapiens
  misc_feature: GZ8MTXP01B3X5G.39.14.B03.1.454.CMB.2.raw
  modified_base (657)..(657): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagcgtggtggagtcggtgggggaggccgtggtcgaagccggtcgggggtccctgagctcctcctgtcgcacgcctcgtggtacttccaccttcagtagctatagcagtgaacgtcgggtcccgcgacggccgtaccggagggggagggcgtagggagggttcgggttctcgacgttcctaagtttacggttacggttaaggttaggttaacgtttaaacctaatttaacgtaaccgtaacgacaacggtaccttacgagggttacgggaaaccggggtccgttaactttacccaaccctaattccccgtaacccgaaaggtaccgaaacccgaaaccgacccgaaaagtaacctaccgtaaccgtgttactacctacggaactaaaagtccgaaacacggccctaggaacgaccggccggtaaagggacccacgggtcgttaggttacgtacgtttacgnggttacgaacggttaggtttaacggttttttcggggtttaggcgttccgttaacgtttaagg

SEQ ID NO: 377964 - DNA, 558 bp, Homo sapiens
  misc_feature: GZ8MTXP01EERXK.39.14.B03.1.454.CMB.2.raw
  modified_base (301)..(301): a, c, t, g, unknown or other
  modified_base (444)..(444): a, c, t, g, unknown or other
  modified_base (489)..(489): a, c, t, g, unknown or other
  modified_base (495)..(495): a, c, t, g, unknown or other
  modified_base (511)..(511): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctggttttccttgttgctattttagaaggtgtccagtgtgaggtgcagctggtggagtcgtgggggagcctggtcaagccgtgggggtccctgagactctcctgtgcagcctctggattcacttcagtagctatagcatgaactgggtccncgaggctcgaggggaggcgtggagtggtctacgactcctagttagtacgtagtagtagttaacataactactacgcagtactcgagtacggaaggtccgattcacatctaccagacacaacgcctaaagaactcactgtactntacgaacaaagtcaaacacggcctagacgacgacggaacgtaacncgggtnttaggtgttaattagnggttgccggttaagttggtttttcgggtttgacgttcgccgtttaag

SEQ ID NO: 377965 - DNA, 631 bp, Homo sapiens
  misc_feature: GZ8MTXP01B69DF.39.14.B03.1.454.CMB.2.raw
  modified_base (281)..(281): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctggttttccttgttgctattttagaaggtgtccagtgtgaggtgcagctggtggagtcgtgggggaggcctggtcaagccgtgggggtccctgagactctctgtgcagctcgtggtattcacttcagtanactaataacagtagaacgtcgggtccgccgaggcctaccggaaggggaacgggggtcgtgggtagtgggtctcatcctattacgtacgtagtagtagtacaattataacgtacgcagactacgtagtaggaaacgggcccgtaattccactatcctaccgaagacgaaccaaccgaccaaacgaactcactagggttactctagaaccaaagtcgaaacgcgtaccgtaggaacgacgacccggaaggaacccgacggttcttaggttgtttaaacttcgttggttcgaccggtttaaggttacgggtttttttcggtttagggagttccgtaaccgttaagtttaacgg

SEQ ID NO: 377966 - DNA, 596 bp, Homo sapiens
  misc_feature: GZ8MTXP01CYXO5.39.14.B03.1.454.CMB.2.raw
  modified_base (220)..(220): a, c, t, g, unknown or other
  modified_base (292)..(292): a, c, t, g, unknown or other
  modified_base (343)..(343): a, c, t, g, unknown or other
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctctgcactggaancagcagtgacgttggtgttatactatgtctctgaccacatcaccaggcaaacgtccccaaatgatgatttangagtacacgtaacgcctagtaggtttctatcgtcttctctgctcaaagtcnggccaacgccggtcctccctgacctatctcgtcggctccgaggcgtaggacggacgtacggcttcgtacttattagttcgctacgtctacaataactaacaagtctaattacgtacgtacggtttggggtaacggttccggggaacggggtaccgggaacgtaaacgggttcggttaaccccggttccgttacgggtaaccgaaccggtccccgtaacgggtcccgttccgtccccccgttcggttaaccccg

SEQ ID NO: 377967 - DNA, 579 bp, Homo sapiens
  misc_feature: GZ8MTXP01DIBU4.39.14.B03.1.454.CMB.2.raw
  modified_base (466)..(466): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgaaactctcctgtgcagcctctggattcacctcagtagctatagcatgaacgtgggtccgccaggctaccgaggggacggggcgtgggaggtgggtctcatccagttacgtcgtagtgtagttacaattataactacgacacgactcgagtggaacgggcctattccacatcctacgagacgacaacgccaaagactcactgtactctagacaaatcgaacncgacctgaagacggcccggaaggaaccacgggttcttggttgttaacttgttaggttcgacgggttaagtttacggtttttcgggtttagggagttcggaaccttaaggttcg

SEQ ID NO: 377968 - DNA, 632 bp, Homo sapiens
  misc_feature: GZ8MTXP01DLVED.39.14.B03.1.454.CMB.2.raw
  modified_base (505)..(505): a, c, t, g, unknown or other
  modified_base (531)..(531): a, c, t, g, unknown or other
  modified_base (564)..(564): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactgggctccgctggttttccttgttgctattttagaaggtgtccagtgtgaggtgcagcgtggtggagtcgtgggggagccgtggtcaagccgtgggggtccctgagactctcctgtgcagcctcgtggtacttcacttcagtagctatagcatgaacgtcgggtcccgccgagcctaccggagggggaacggggcgtgggaaggtgggtcctcacttacctaagtttacggtagttaaggtaagttaagttaaacaattaactaacgtaacgcaacgtaactacgaggtacggaaaccgggcctaattaccaacctataccaccgaagaacgaaccaaaccgaccaaagtaactccaaaggtttntaactcgagaaactaaagacgaaacncgacgtaggaacgaccggacggaagacgacgtnttgtagttattcgttggttacgtaacggttaggttttcggtttttcgggttagacttcgaaccgtaag

SEQ ID NO: 377969 - DNA, 737 bp, Homo sapiens
  misc_feature: GZ8MTXP01AX71E.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcggtgggggaggcctggtcaagccgtggggggtccctgagactctcctgtgcagcctctggacttcaccttcagtagctatagcatgaacgtcgggtcccgccgaggccgtacgagggggaaggggctgggagtgggtctcatcctattaggtcgtaagtagtagttaaacattaactactacgcaagtactacgaggtcggaaacggggccctaattaccaacctactacctacccgaaaggaaccgaaacccgaaacccggaaccctaaaacggtaaccttaccgtaaacggttacggttaaacttcccgtaaggtaaacccaaaagttacgaaaacccgtacggacccgttaagggaacggaaaccgggaccccgggtaaacgggaaacccgttaaacgggggtccttacgggttaaggtttaacgtttaacccggttggttacggtaacccgggttaagggttttaacgggtttttttaccgggggtttttagggaacggtttcgttaaccccggtttaaggg

SEQ ID NO: 377970 - DNA, 517 bp, Homo sapiens
  misc_feature: GZ8MTXP01CYCUS.39.14.B03.1.454.CMB.2.raw
  modified_base (305)..(305): a, c, t, g, unknown or other
  modified_base (376)..(376): a, c, t, g, unknown or other
  modified_base (448)..(448): a, c, t, g, unknown or other
  modified_base (475)..(475): a, c, t, g, unknown or other
  modified_base (486)..(486): a, c, t, g, unknown or other
  modified_base (488)..(488): a, c, t, g, unknown or other
  modified_base (490)..(490): a, c, t, g, unknown or other
  modified_base (509)..(509): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtggctatagcatgaactgggtccncaggctcgaggggacggggctggagtggtctcgatccattagtcgtagtagtagttaacataatactacgnagactcagtgaaggccattcacatctacagagacaacgccaaagtactcaactgtaatcagacaaatcgaanagcctgagacgccgtaaggacacggtnttgtatattgngngngtagttcgttttggttagngtcgcgtg

SEQ ID NO: 377971 - DNA, 755 bp, Homo sapiens
  misc_feature: GZ8MTXP01CH03P.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtcctgagactctcctgtgcagcctctggtattcaccttcagtagctatagcatgaacgtcgggtccgccgacggccgtaccggagggggaacgggggtccgtaggggtacggttcgggggttcctacgtacgttacccgtaagtttacggttacggttaaggtttaacgttaagtttaaaccaaagtttaactaaccgttaacgacgtacgtaacgtacgtaagggtacgggaaacggggtccctaacgttccaaaccctattaccgtaccccgaaggaaccgaaccgtaaacccggaacccaaaacggaaccttacccgtaaacgttacgtttaacgttacctaaggaaccctaaaagttacggaaaccttaccggccgtaagggaacggaccgggaacccggaacgggtaccggaacgggttccgtttggtaaagtttacgtttacgttggttacggttaagggttaggttttaagggttttttccgggtttgaacggtttcgccgttttaag

SEQ ID NO: 377972 - DNA, 625 bp, Homo sapiens
  misc_feature: GZ8MTXP01DB8GE.39.14.B03.1.454.CMB.2.raw
  modified_base (309)..(309): a, c, t, g, unknown or other
  modified_base (562)..(562): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagcgtgggtggaggtcgtgggggaggcctggtcaagccgtgggggtccctgagactctcctgtgcagcctcgtggattcaccttcagtagctatagcatgaactcgggtccnccgaggctccgaggggaagggcgtggagttggtctcatcctagttaggtcgtagtagtagttaaacataatactacgacagactacgaggtacgggaacgggtcccgtaacttccaacctattcccgaacccgaaggaacgaacccgtaaaccgacccgaaaagtaacccttacctaacgttacgttaacttcgtaacgaaccaaaagtcggaaacctagccctagaacggacgccggaaaggtacgacggtnttgtagtacttagttgacggttcgtagttttcggtttttgggttggagtcgttaaccgttaag

SEQ ID NO: 377973 - DNA, 571 bp, Homo sapiens
  misc_feature: GZ8MTXP01DQFUD.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtcgtgggggaggcctggtcaagccgtgggggtccctgagactctcctgtgcagcctctggattcaccttcagtagctatagcatgaaacgtcgggtcccgccgacggcctccggagggggaacgggggcgtgggaggtgggtctcactcctaattaggtacgtaagtagtagttaacataatactacgcagactcgagtagaacggcctattcaccatcacagagacaacgacaaagactcacgtgtatctagacaaaatgaaacacgcctagacgacgcccggaaggacacgggtcttgtagtaattacgttggttacgtaaggttagttggttttttacgggttggacgttcgcgttaag

SEQ ID NO: 377974 - DNA, 608 bp, Homo sapiens
  misc_feature: GZ8MTXP01C5EZY.39.14.B03.1.454.CMB.2.raw
  modified_base (311)..(311): a, c, t, g, unknown or other
  modified_base (542)..(542): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagcgtggtggagtcgtgggggaggcctggtcaaggccgtggggggtccctgagactctcctgtgcagcctctggtattccaccttcagtagctatagcatgaacgtgggtcccnccgacggctaccgagggggagggctggaggtggtctcatcctagttggtacgtagtagtagttaaacataactactacgacagactacgagggtagacgggcctattaccactactcctacagacaacaacgaccaaagaactcagttagtatacctagaacaaagtcgaacacgccgtaggacggacgaccgggaaagaccgacgggtcgttagttaggtactttaacgngggttaggtaaccggttaggtttaacggggttttttcgggtttagggaacgttcggcctttaaggg

SEQ ID NO: 377975 - DNA, 617 bp, Homo sapiens
  misc_feature: GZ8MTXP01CYSTY.39.14.B03.1.454.CMB.2.raw
  modified_base (285)..(285): a, c, t, g, unknown or other
  modified_base (317)..(317): a, c, t, g, unknown or other
  modified_base (510)..(510): a, c, t, g, unknown or other
  modified_base (538)..(538): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgcttgggttttccttgttgctattttagaaggtgtccagtgtgaggtgcagcgtggtggagtcggtgggggaggcctggtcaaggccggtggggggtccctgacgactctcctgtgcagcctctggattcaccttnagtagctatagcatcgaaacgtcggggtcccnccgaggcctaccggagggggaacggggtctgggaggtcggtctcactcctagttaggtacgtagtagtagttaaacaattaactactacgacacgactcgaggtacggaacgggtcctaattccaactattcccacgagaacgaaccaacgaccaaagaacctcacgtgtactctagaaccaaagtcgaaacncgacctagacgacggtaccgaaggaacncggtcttggttactattacgttgttaggtaacgttaagggtttcgttttttcggggttaggacgttcgttccgtttaag

SEQ ID NO: 377976 - DNA, 609 bp, Homo sapiens
  misc_feature: GZ8MTXP01AW9D2.39.14.B03.1.454.CMB.2.raw
  modified_base (270)..(270): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgcttattttagaaggtgtccagtgtgaggtgcagcgtggtggagtcgtggggggaggcctggtcaaggccgtggggggtccctgagactctctgtgcagccttntggattcaccttcagtagctatacgacatgaactggggtcccgccgaggcctaccggagggggaacggggctgggaggttgggtctcgtatcctattaggtcgtagtagtagttaacattaatactacgacagtactcgaaggtggaaacggggtcaattccaccatcctaccgaagacgaacaacggacaaagactcaacgtgtatctagaacaaatcgaaacaggacctaggacgacggcccggaaggacgttacgggtcttgttagtaagtttcgttggttggtaaccggttagttttcgggtttttcgggttttagggactttcggccgtttaag

SEQ ID NO: 377977 - DNA, 732 bp, Homo sapiens
  misc_feature: GZ8MTXP01B4DFC.39.14.B03.1.454.CMB.2.raw
  modified_base (308)..(308): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagcgtggtggagtcgtgggggacgccgtggtcaagccgtgggggtccctgacgctctcctgtgcagtccctgtggacttcaccttcagtagctatgcatgaactgggtccncgagctcgaggggaggctgggagtggtctcgtactacctagtttacggtacgttaagtacgttaggttaaactaataacttaaacgtaccgacgaacgtactacgagttaggaacggggtcctaacttacaaccctattacccgaaccgagaacgaaacccgaaacccgaacccggaaacgtaaacttaccccgaaggtttacgtaacgtttacccgaaaggaacctaaaacgttacgaaacgtaccggtacccgtaagggaacgaaccggggtaccccggaacgggaaacccgttcggggttcccttagggtttaaacgttaacgttttaacccgggttcggtttagggtaaccggttaaacggggtttttgggtttttttaccggggtttacgggttaagttccgttaacccgtttaaaggg

SEQ ID NO: 377978 - DNA, 774 bp, Homo sapiens
  misc_feature: GZ8MTXP01AOASW.39.14.B03.1.454.CMB.2.raw
  modified_base (242)..(242): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcagccgtgggggtcccngacgactctcctgtgcagcctcgtggacttcaccttcagtagctatagcagtgaacgtcgggtccgccgaggcctccggagggggacggggtcgtaggggtaggttcgggtctacgacgttaccgtaagttttaggtacggttaagttaacggttaacggttaaacctaattaataaccgtaccgacaacgtaccttacgaagggttacggaacggggtacccttaacgttaccaaccctattaccgtacccgaaggaacgaaaccgaaaccgaacccgaaacgtaacctacctaacgttacgttactaccgttaagaaacctaaaagtcggaaaaccctacgggtaccctaaggggaacggaacccgggacccccgggaaagggttaacccgacccgggggtaccttttacgggttaagtttaacccgtttaaaggttcgggttacggggttaaaccgggttagggtttttaaccggggtttttttccgggggtttttaggaacgggtttcccgttaagtttaaaccgggg

SEQ ID NO: 377979 - DNA, 585 bp, Homo sapiens
  misc_feature: GZ8MTXP01BXPWN.39.14.B03.1.454.CMB.2.raw
  modified_base (185)..(185): a, c, t, g, unknown or other
  modified_base (273)..(273): a, c, t, g, unknown or other
  modified_base (293)..(293): a, c, t, g, unknown or other
  modified_base (320)..(320): a, c, t, g, unknown or other
  modified_base (343)..(343): a, c, t, g, unknown or other
  modified_base (435)..(435): a, c, t, g, unknown or other
  modified_base (464)..(464): a, c, t, g, unknown or other
  modified_base (476)..(476): a, c, t, g, unknown or other
  modified_base (519)..(519): a, c, t, g, unknown or other
  modified_base (524)..(524): a, c, t, g, unknown or other
  modified_base (538)..(538): a, c, t, g, unknown or other
tcagtcgcactagtcacgaccggtgctcgatttagtgtgagtagttccgcgggggagctctgagagaggagccttagccctggattccaaggcctatccacttggtgatcagcactgagcaccgaggattcaccatggaactggggctccgcttgggttttccttgttgcttattttagaaggtntccagtgtgaggtgcagcgtggtggagtcggtgggggagcctggtacaagccgtggggggtccctgagactctcctgtgcagcctcgngattcacgtcagtagcctanagcatgaaccgtggtccccacgaggcnccggtagggggaacggcgtaggnggtgggtctcgacttccaacgtttaggtcgtagttaggtacttaaccagttaatactacgcaggtactcgagtggacgggcctattcaacgnttaccacaggaacaccaaagcccctaaanactcacgtgtanacagaacaagtacactcgacgtagaggaccgacggaaggtacncggtnttgttagtagttgnggttggtaacggttgtttcgggttttacgggtggacttcgcgttaag

SEQ ID NO: 377980 - DNA, 649 bp, Homo sapiens
  misc_feature: GZ8MTXP01AQ2SZ.39.14.B03.1.454.CMB.2.raw
  modified_base (364)..(364): a, c, t, g, unknown or other
  modified_base (392)..(392): a, c, t, g, unknown or other
  modified_base (402)..(402): a, c, t, g, unknown or other
  modified_base (553)..(553): a, c, t, g, unknown or other
tcagtcgcactagtcacgaccggtgctcgatttagtgtgagtagtcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgactaagtgtcgccatcgaccgtgggtcccgccgaggcctcggaaggggaggggctgggagtgggtctagtagtttataggtggtagtggtagtagcacgagtattacgacagaccgtcgtaggaacgggtccgttcaccgtactctacgagagacctaattaccaanacgcaacgtcttagtactttgactaacngtaacgaacncgctaggagacgaccgacggacgcggactaagtacttattagttacgtgtaaccgttaacttttcgttagtaccgttagtttacttaccttaccccgtagttacgaaccgtacggcgggtaccgacgggtaccctagtcccgaccgttccnccttcgaccgccctacgaccgacggttcccctacgtcccgttcccgttccccgcggccctacccctcctaaccgcgttacctccgaaccgtccggg

SEQ ID NO: 377981 - DNA, 514 bp, Homo sapiens
  misc_feature: GZ8MTXP02FMLLD.39.14.B03.1.454.CMB.2.raw
  modified_base (222)..(222): a, c, t, g, unknown or other
  modified_base (301)..(301): a, c, t, g, unknown or other
  modified_base (510)..(514): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcagtgacgttggtaggttataactatgtctctggtaccaacagcaccaggacaaacgcccccaaatcatgatttangagctgaggacgaggctgattatactgcagctacatatacaagcagcagcactcttgtgttatcgggaggaggaccaagctagaccgtcgtagtcacgcccaaggcctcgccccctggtccaccttcttccgtcccctaccctccgtccacgtagtcgaccgtacgtcggacggccgggccgtaggaccgaaggggcccacgtaagcgnnnnn

SEQ ID NO: 377982 - DNA, 584 bp, Homo sapiens
  misc_feature: GZ8MTXP02FS5NF.39.14.B03.1.454.CMB.2.raw
  modified_base (301)..(301): a, c, t, g, unknown or other
  modified_base (332)..(332): a, c, t, g, unknown or other
  modified_base (579)..(584): a, c, t, g, unknown or other
tcagtcgcactagtcacgaccggtgctcgatttagtgtgagtagttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtgttataactatgtctcctggtaccaacagcacccaggccaaacgcccccaaatcatgatttagngagctaggaggacgagctagtaattataccngcagctacaataactacaagcaagcagctacttcgttagtggttagtcggggacggaacgggaaccaagccgtacggtacccgttacgtacggtccaaccggaccccgaaggtcccgttcccgtccccccgtttacggttaccctcccgttcccgttaccccctaccccttccctacctaaccgttacgtacgtaccgtacgtcggacgggccgggtcgtcgggaccgacgggccaacgtagtacgnnnnnn

SEQ ID NO: 377983 - DNA, 570 bp, Homo sapiens
  misc_feature: GZ8MTXP02HG7Y1.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactcgggtccgccaggcctccgaggggaaggggctgggagtgggtctcatccattagtcgtagtagtagttacatatactacgcagactcagtgaacgggccattccacatccacagacgacaacgacaaagtaacctcaactgtaatctagacaaaagtgaaacagacctaggaagacggacccggaaggtaccacgggtcttaggtacgttattacgtggtggaacgttaggttaggttttttcgggttttaggacgtttcggaccctttaagg

SEQ ID NO: 377984 - DNA, 524 bp, Homo sapiens
  misc_feature: GZ8MTXP02GJYHH.39.14.B03.1.454.CMB.2.raw
  modified_base (429)..(429): a, c, t, g, unknown or other
  modified_base (444)..(444): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggtccctgagactctcctgtgcagcctctggattcaccttcagtagctatagcatgaactgggtccgccaggctccgaggggaaggggctggagtgggtctcatccattagtcgtagtagtagtacatatactacgcagactcagtgagggccagttcacatctaccagacgacaacgccaagactcactgtanctagacaaatgaacngcctagagagccggaggtacacgggtctagtcgttacttacgtgtagcgtagttagttttcggtttgacgttcgccttag

SEQ ID NO: 377985 - DNA, 640 bp, Homo sapiens
  misc_feature: GZ8MTXP02JQB7W.39.14.B03.1.454.CMB.2.raw
  modified_base (222)..(222): a, c, t, g, unknown or other
  modified_base (248)..(248): a, c, t, g, unknown or other
  modified_base (260)..(260): a, c, t, g, unknown or other
tcagtcgcactagtcacgaccggtgctcgatttagtgtgagtagttccgcggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttataactatntctctgtaccanatcaccagaacaagtccccaaatgatgtattatgagtcactaaacgcctcgtagggtttctaatcgtcttcctcgtgtcctcctaagtccttacgggccaaaccgacggtcccctacccgtacgaccctactcccgtcgtcggggtccctcccgaggtccgtagggacggaccggtaggtccttacgttaccttactttagttcgacgtaacgtccttactaattaacgtaaactaaacgtactaaattttacgtaccgttaacggtttggggtacggtttccggggacggggtaaccggggaccgtaccgtcgtaaccgttcgtttaacggccgaacgtacccgaacggtcctccggtcccccgttcggtccttacccg

SEQ ID NO: 377986 - DNA, 535 bp, Homo sapiens
  misc_feature: GZ8MTXP02HJNA0.39.14.B03.1.454.CMB.2.raw
  modified_base (448)..(448): a, c, t, g, unknown or other
  modified_base (463)..(463): a, c, t, g, unknown or other
  modified_base (481)..(481): a, c, t, g, unknown or other
  modified_base (498)..(498): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctggagactctcctgtgcagcctctggattccaccttcagtagctatagcatgaactcggggtccgccgaggctccgaggggaaggggctgggagtgggtctcatccagttagtcgtagtagttagttacatatactagcagactcagtagaaagggccattccacctatccctcaagacgaacaacgaccaaagactcactgtanctgacaaatgaaacngcagagacgacgaggacncgctagtatactcgtgngaacgtagtttcggtttttcggttgacgtcgtactag

SEQ ID NO: 377987 - DNA, 523 bp, Homo sapiens
  misc_feature: GZ8MTXP02GQ4K8.39.14.B03.1.454.CMB.2.raw
  modified_base (394)..(394): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaccttcagtagctatagcatgaactgggtccgccaggctccgagggaaggggctggagtgggtctcatccattagtcgtagtagtagtacatatactacgcagactcagtgaaggcatcacntctcagagacaacgcaaagactcactgtatctgacaaatgaacagcctgacgagccgaggacaggctggtatacttaactgttagcggtaagttaggtttttcggttttagggagttcggacctttaag

SEQ ID NO: 377988 - DNA, 513 bp, Homo sapiens
  misc_feature: GZ8MTXP02HRELY.39.14.B03.1.454.CMB.2.raw
  modified_base (304)..(304): a, c, t, g, unknown or other
  modified_base (376)..(376): a, c, t, g, unknown or other
  modified_base (408)..(408): a, c, t, g, unknown or other
  modified_base (485)..(485): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactgggtccnccaggcctcgaggggaagggctgggagtgggtctcatccattagtcgtagtagttagttacatatactacgnagactcagtgaagggcattcaccatcacaganacaacgccaaagactcactgtatctgactaaagagaacagcagagagacgacggacgacgcgtgtgtagtactgtgngagtagtttcggtttggttcgtgtctag

SEQ ID NO: 377989 - DNA, 602 bp, Homo sapiens
  misc_feature: GZ8MTXP02IMWJX.39.14.B03.1.454.CMB.2.raw
  modified_base (222)..(222): a, c, t, g, unknown or other
  modified_base (262)..(262): a, c, t, g, unknown or other
  modified_base (299)..(299): a, c, t, g, unknown or other
  modified_base (328)..(328): a, c, t, g, unknown or other
  modified_base (598)..(598): a, c, t, g, unknown or other
  modified_base (600)..(602): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcagtgacgttggtagttatactatgtctctgaccaanagcacccaggaccaaacgccccaaatcatgatttagngagctaggaggagaggctagaattatacngacagtctacaattatacaagcagcacgcactttcgttggttaggtaagttccggggacggggtaacgggaacccgtaaaggtccgtacggtaacccgttaccgtacgggtaccgaccggaccccgtaaacggtcccgttacccgtccccccgttcgggtaccctacccgttcccgttacccgttacccccaccccttaccctaccgtacgttaacggttcgaccgtacggtcggacggccgggtcgtacggacgaacggcgacaagcgncnnn

SEQ ID NO: 377990 - DNA, 524 bp, Homo sapiens
  misc_feature: GZ8MTXP02HB7GE.39.14.B03.1.454.CMB.2.raw
  modified_base (377)..(377): a, c, t, g, unknown or other
  modified_base (385)..(385): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcatcaccatctcctgcactggaagcagcagtgacgttggtagttataattatgtctcctggtccaacagcattcagcagccgccccgaaactcttaaatttatgtacggttctttcgtcggtccctcgtaggggtttcagtcgccttctccgctcagtctgcaacacgccctccctgacctntcctctanacctcagctgagacgagctagacttagttattcgacagtctcatatactagaagtcaaagtgtactacacgttcggcttggtcggcggacggacaacgttcgaccgtcgtacgtcacgaccaacggtcctcgtcccccg

SEQ ID NO: 377991 - DNA, 613 bp, Homo sapiens
  misc_feature: GZ8MTXP02IJCPO.39.14.B03.1.454.CMB.2.raw
  modified_base (433)..(433): a, c, t, g, unknown or other
  modified_base (463)..(463): a, c, t, g, unknown or other
  modified_base (482)..(482): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctctgtgcagcctctggattccaccttcagtacgctaatagcatagaacgtcggggtcccgcgacggcctaccggaggggaaggggcgtgggaggtgggtctcgatcctagttacgtcgtagtagtagttacatatactacgacagactcgagtacgaacgggcattcactatcctacaganacaaacgaccaaagaacctcaactgtactntagaactaaagtcgaaacncgtaccaggaacgacgggacccggaacggaaacgccgggtacgttaggtaagttaacgttaaccgttggttacggcggtttaaggtttacgggtttttttcggggtttaggaggtttccgaccgtttaagg

SEQ ID NO: 377992 - DNA, 561 bp, Homo sapiens
  misc_feature: GZ8MTXP02G5WT4.39.14.B03.1.454.CMB.2.raw
  modified_base (367)..(367): a, c, t, g, unknown or other
  modified_base (425)..(425): a, c, t, g, unknown or other
  modified_base (433)..(433): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtgggggtccctgagactctcctgtgcagcctctggattcaccttcagtagctatagcatgaactgggtccgcgaggctccgaggggaaggggctggaggtgggtctcatccattagtcgtagtagtagttacatntactacgcagactcagtgaagggccattcacctatcctacagacgacaacgcaagacncactgtanctagacaaatgaactagccgtagagacgaccggtaacggaccgtacgggccttaggtacgttacgttacgtggtaggaacggttaggttacggttttttcgggtttaggacggtttcgaccgtttaag

SEQ ID NO: 377993 - DNA, 569 bp, Homo sapiens
  misc_feature: GZ8MTXP02F5D88.39.14.B03.1.454.CMB.2.raw
  modified_base (562)..(562): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctataacatgaacgtggtccgccaggctccgaggggaaggggctgggaggtgggtctcgatcctattacgtcgtagtagtagttacatatactacgcagactcgagtaggaagggcctattaccacctatcctaccgagacgacaacgccaaagactcactgtactctagacaaaatcgaacagccctaggacgacgacccggaggaaccacggggtctggttattacttaccgtgtggtacgtaaggtttaggtttttcgggtttagagtcgaccgtntttacgg

SEQ ID NO: 377994 - DNA, 569 bp, Homo sapiens
  misc_feature: GZ8MTXP02H2BFS.39.14.B03.1.454.CMB.2.raw
  modified_base (378)..(378): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgtgcagcctctggattcaccttcagtagctatagcatgaactggggtccgccgaggctccgaggggaaggggctgggagtgggtctcatccattagtcgtagtagttagttacatatactacncagactcagtagaacgggccattccacctatcctaccaagacgaacaaacgccaaagaacctcaactgtactctagacaaaatgaaacaggcctaggaacggacgacccggagggaacctacggggcttggtagttactacgttggcgaacggttagttaggttttttccgggtttagagttcgaccttag

SEQ ID NO: 377995 - DNA, 592 bp, Homo sapiens
  misc_feature: GZ8MTXP02F4WHP.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccgccaggcctccgaggggaaggggctggaggtgggtctcatccattagtcgtagtagtagttacatatactacgcagactacagtgaaggggccattccaccatctaccagacgaacaacgaccaaagaactcacttagtatctagacaaaatgaaacagaccctaggaacgacggacccggaaagggaccaaacgggtctaggttacggttactttaaccgtggtacggaaccggtaagggtttacggttttttacggggttttaggaacgttcggtaccctttaagg

SEQ ID NO: 377996 - DNA, 512 bp, Homo sapiens
  misc_feature: GZ8MTXP02F21SJ.39.14.B03.1.454.CMB.2.raw
  modified_base (379)..(379): a, c, t, g, unknown or other
  modified_base (448)..(448): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggtccctgagactctcctgtgcagcctctggattcaccttcagtagctatagcatgaactgggtccgccaggctccgaggggaaggggctggagtgggtctcatccattagtcgtagtagtagttacatatactacgcagactnagtgaaagggccgattcaccatctccagagacaacgccaaagaactcactgtatctgacaaatgaaacngcctgagagccgaggacacggctgtgtattactgtgcgagtagttttcggtttggagtcgctag

SEQ ID NO: 377997 - DNA, 532 bp, Homo sapiens
  misc_feature: GZ8MTXP02JC9OP.39.14.B03.1.454.CMB.2.raw
  modified_base (491)..(491): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggatcaccttcagtagctatagcatgaactgggtccgccaggctccgaggggaacggggctgggagtgggtctcgatccattagtcgtagtagtagttacatatactacgcagactcagtgaacgggctatcacatctcagagacacgccaagaactcactgtatctagacaaatcgaacaggtccagaggacgccggaaggacacggctgtagttacttacgngtcgaagtagttaggtttttcggtttagggcgttcgactag

SEQ ID NO: 377998 - DNA, 526 bp, Homo sapiens
  misc_feature: GZ8MTXP02GTUBI.39.14.B03.1.454.CMB.2.raw
  modified_base (367)..(367): a, c, t, g, unknown or other
  modified_base (433)..(433): a, c, t, g, unknown or other
  modified_base (449)..(449): a, c, t, g, unknown or other
  modified_base (489)..(489): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccgccaggctccgaggggaaggggctggagtgggtctcatccattagcgtagtagtagttacatntactacgcagactcagtgaagggccattcaccatcacagacaacaacgccaaagaactcactgtanctagacaaatgaaacngacctgagacgacgaggacacgggctagtagtacttacgngtagcgtagttaggttttcggtttagacgtcgactag

SEQ ID NO: 377999 - DNA, 556 bp, Homo sapiens
  misc_feature: GZ8MTXP02GOT6T.39.14.B03.1.454.CMB.2.raw
  modified_base (264)..(264): a, c, t, g, unknown or other
  modified_base (282)..(282): a, c, t, g, unknown or other
  modified_base (305)..(305): a, c, t, g, unknown or other
  modified_base (381)..(381): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctntggattcaccttcagtanctatagcatgaactggggtcccncgaggcctccgaggggaaggggctgggaggtgggtctcatccagttagtcgtagtagtagttacattatactacgnagactcagtagaagggcctatcaacatcacagacgacaacgaccaaagacctcactgtatctagacaaaagtgaaacagccctagaacgaggacccggagggtaaccacgggtacttaggtattacgttacgtgtaggaacgtagtttaggtttttcggttaggagtcgccttag

SEQ ID NO: 378000 - DNA, 569 bp, Homo sapiens
  misc_feature: GZ8MTXP02IZQ7J.39.14.B03.1.454.CMB.2.raw
  modified_base (428)..(428): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcacgtggaagcagcagtgacgttggtggttataactatgtctcttggtaccaacatcacccaggacaaacgtccccaaactcgatgatttatgagtcactaaacggcctcaggggtttcaatcgcttctctgctcatctgcaacacgcctcctcgaccatctcgtgggcctccgaggctgacggacgacggctctcttattattgcctagctanatatacaagctaattatacgacgttgggtcgtttcgggacggtacgggacccgtacgttacggacccgttcgtttaacgggtccaacgggtaccccgtaaacgggtcccgttaccggtccccccgttaccgggtttccccg

SEQ ID NO: 378001 - DNA, 632 bp, Homo sapiens
  misc_feature: GZ8MTXP02F2XBJ.39.14.B03.1.454.CMB.2.raw
  modified_base (300)..(300): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaagcagcagtgacgttggtgttataactatgtctcttggtaccacatcacccaggacaaacgtccccaaactgatgatttangagtcactaaacgcctgtagggtttctaatcgcttctctgctcaagtctggcctaaacgaccggtccctccctcgaccacttcctcgtcggggtcctccgagggtccttaggacgggaccgtacggtctaccttcttaagtttacttggcccagtacctacattaactaaccgaagtctaatttactacgtaccgtttggggttacgtttcgggggaccgggtacgggggtaacccgtaccgtacgggtaacccgttcgtttaacgggtaaccgtaaccggaccccgtaaacgggggcccttcccggtacccccccgttcgggttaaccccg

SEQ ID NO: 378002 - DNA, 671 bp, Homo sapiens
  misc_feature: GZ8MTXP02GOXOU.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttcctgttgctattttagaaggtgtccagtgtgaggtgcagctggtggagtccgggtggggacgtcgtggtacacgtcgggtcgggggtccagacgtacctcctcgtgtcgcacgtcctgtggtacttcctaccttcgaggtactactaagacgactagtacgtaacggttccggggaccccgaccgagggtcccaccggggaagggggtaacggcggtagggtagggttcggtctacgactactagttacgtacgtagtaggttactactattactactacgacagtcctagaggtacgggaaacgggtctaacttaccaacctatacccgtacgaagtacaaaccgaccgaaactaaacgaaacctcctagttacgtactacgagaaaccaaagtacgaaacgcgtacgaggaacgcgtaccgaacggaccgtacgggttcttaggtacttacgttcgtggtacgtaaggtttacggtttttacgggtttcggtagtccggttacgtactag

SEQ ID NO: 378003 - DNA, 525 bp, Homo sapiens
  misc_feature: GZ8MTXP02GF3AV.39.14.B03.1.454.CMB.2.raw
  modified_base (301)..(301): a, c, t, g, unknown or other
  modified_base (328)..(328): a, c, t, g, unknown or other
  modified_base (342)..(342): a, c, t, g, unknown or other
  modified_base (397)..(397): a, c, t, g, unknown or other
  modified_base (412)..(412): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaacaccccggcaaacgcccccgaagtcatgatttangacgtcactaatcggccctgaggggtntctaatcgcttccnctgctcaagtctggcaacacggcctcctgaccatctctggctccagctgagacgngctagattatacgtncagctcatatcaagctagtaatactgtccgtttcgggacggtaggaccaaagtcacggtaacccgtcgttacggcaacgcccgaaggcctaccgcccccgttcggacctaccg

SEQ ID NO: 378004 - DNA, 731 bp, Homo sapiens
  misc_feature: GZ8MTXP02GW1U8.39.14.B03.1.454.CMB.2.raw
tcagtcgcactagtcacgaccggtgctcgatttagtgtgagtagtcccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagctatacgtacgtcgggtccgcgacgccgtacggaggggaacgggtcggtaggggtaggttcgggtcctacgtaccgtaccgtaagtttacggttaccgttaaggtaaggtttaacgttaacttaagttactaaccgtaccgtacgaacgtaccgtaacggacgggtaacgggtaaaccggggtaccgtaaccgttaccctaacccgtacttcccgtaccgaacggaaaccgaaacccgaaaccgaaaccgaaaaccgtaaaccttaaccgtaacttaacggttacttacgacggtaaaactaaacgtaaacgaacgaacgtacccgtaggaaaccggacggaaccggaacggaaccggacggtcgttaggttacgttacgttacgtcgtacggtaagttacgggtttaggtttttcggttaggttcgtcgtacgtttaacgg

SEQ ID NO: 378005 - DNA, 537 bp, Homo sapiens
  misc_feature: GZ8MTXP02HA0I1.39.14.B03.1.454.CMB.2.raw
  modified_base (449)..(449): a, c, t, g, unknown or other
  modified_base (462)..(462): a, c, t, g, unknown or other
  modified_base (488)..(488): a, c, t, g, unknown or other
  modified_base (501)..(501): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtggtccgccaggctccgaggggagggctgggagtgggtctcgatcccgattagtagtagttctagttacattatcttatgcagcctcgagtgaaacggccgtattccaacctatccacagacgacgacgaccaagactcgagttcgtttcngacaaagtgaacngcctagagacgaccgaggacacggtnttacctttatacngtacgcgagaggacggtacaaggtacctacgtacgg

SEQ ID NO: 378006 - DNA, 603 bp, Homo sapiens
  misc_feature: GZ8MTXP02G3C0O.39.14.B03.1.454.CMB.2.raw
  modified_base (481)..(481): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggacttccaccttcagtagctatagcatagaactcggggtcccgccgaggcctccgaggggaaggggcgtgggagtgggtctcatccagttagtcgtagtagtagttacatatactacgcagacctcgagtggaaacggggccattccgaacctatcctacgaggaacgaccaaaccgacaaagaacctcaactgtatcctagacaaagtgaaacngacctaggaacgacggacccggaaggtaccgacggtcttaggttagttacgttacgtgggtacggtaacgttaggtttaacggtttttttcggggtttaggtacgttacggtacctttaagg

SEQ ID NO: 378007 - DNA, 562 bp, Homo sapiens
  misc_feature: GZ8MTXP02IX2B1.39.14.B03.1.454.CMB.2.raw
  modified_base (342)..(342): a, c, t, g, unknown or other
  modified_base (371)..(371): a, c, t, g, unknown or other
  modified_base (451)..(451): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttcctgttgctattttagaaggtgtccagtgtgaggtgcagctggtggagtcgtgggggagcctggtcaagccgtgggggtccctgagactctcctgtgcagcctctggacttcaccttcagtagctatagcatgaacgtgggtccgccaggcctccgaggggaacgggctgggaggtgggtctnatccagttagtcgtagtagttagtacatntactacgcagactcagtagaacgggccattcacatcacagacacaacgcaagaactcactgtatcagaacaatacgaacngaccgtgagacggacgaacggacgcggtactggttacgttacttacgtggtacgtccggttaaagggtttcggtttttacggggttttaggcggttacgtaccgtttaagg

SEQ ID NO: 378008 - DNA, 541 bp, Homo sapiens
  misc_feature: GZ8MTXP02IPZDA.39.14.B03.1.454.CMB.2.raw
  modified_base (305)..(305): a, c, t, g, unknown or other
  modified_base (341)..(341): a, c, t, g, unknown or other
  modified_base (369)..(369): a, c, t, g, unknown or other
  modified_base (400)..(400): a, c, t, g, unknown or other
  modified_base (403)..(403): a, c, t, g, unknown or other
  modified_base (424)..(424): a, c, t, g, unknown or other
  modified_base (431)..(431): a, c, t, g, unknown or other
  modified_base (446)..(446): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccnccaggcctccgaggggaagggctgggagtgggtctnatccattagtcgtagtagtagttacatntactacgcagactcagtgaaacggcatcacntcncagacgacaacgcaaagactnactgtanctgacaaatgaaacngcctagagacgaccgagacgacggctaggtagttacttacgtggtacgaacgtaggttacggtttttcgggtttaggacgttcggtaccttaagg

SEQ ID NO: 378009 - DNA, 562 bp, Homo sapiens
  misc_feature: GZ8MTXP02JTJ2K.39.14.B03.1.454.CMB.2.raw
  modified_base (438)..(438): a, c, t, g, unknown or other
tcagtcgcactagtcacgaccggtgctcgatttagtgtgagtagttccggcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccagcagtgacgttggtagttataactatgtctcttgtaccaacatcacccaggaccaaacgtccccaaactgatgtatttatgagtcaacgtaacgccctagagggtttactaatcgtcttctctgctaccaagtctgcaacacggtccctcctgacctatctcgtcgggcctccgaggctagacggacgaggctcgtcttattatgcacgtctanatatacagactattatactacgttgggtcgttcgggacggacgggacccgtacgtacggtaccgttacgttacggtacgaacggacccgtaacggccgtccgcccccgtacggtaccttacccg

SEQ ID NO: 378010 - DNA, 595 bp, Homo sapiens
  misc_feature: GZ8MTXP02JQ4V8.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtgactatagcatgaacgtggggtcccgccaggcctccggaggggaaggggcgtagggaggtggggtctcatccattagtcgtagtagtagttacatactactacgcagactcaggtgaaacgggccgtaattccacccatccctaccagaacgaaccaaaccgccaaagaacctcaaatcgtaatcctagacaaaatcgaaacacgcctaggacggacgaacccggtaggacccgacgggtactgttacggttacttacgtggttacgcgggttaagtttacggtttttacgggttggaaggttcgaccgtttag

SEQ ID NO: 378011 - DNA, 708 bp, Homo sapiens
  misc_feature: GZ8MTXP02IXIUH.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactgggctccgctggttttcctgttgctattttagaggtgtccagtgtgaggtgcagctggtggagtcgtgggggaggcctggtcaagccgtgggggtccctgagactctcctgtgcagcctctggacttccaccttcagtagctatagctatggaacgtcggggtcccgccgagggccctaccggaagggggaacggggtcgtggggacggttcggggtcctcgaacgttcccgtaagtttagtaccgttaaggtaacgttaagttaacaattacgtacctaacgacctagacctacgaaggtacggaaacggggtccctaattcccaacctacgttcccaccgaagaacgaacccaaacccgaccaaaagtaaccctcctaaacgttacgttaatcccgtagaaaccctaaaaagtcggaaaaccacggaaccctaggaaaccggacggaacccgggtaaacggacccgaacgggtccgttagttaacgttactttaaccgtggtacggtaacggtttaaggttttacgggtttttacggggtttggaacggtttcgtacctttaagg

SEQ ID NO: 378012 - DNA, 609 bp, Homo sapiens
  misc_feature: GZ8MTXP02GUFFE.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactgggtcccgccaggctccgaggggaaggggctgggaggtgggtctcatccattagtcgtagtagttagttacattactactacgcagactacgagtacggaaagggtcccgtattccaccatcccgtacccaggaacaccgaaaccgaccaaaagaacctccaacttgtaacttctagactaaaacgtcgaaacacgacctaggagacggcccggaaagggtaccacgggtacttgggtattacgttacgtggttacggaacggttaggtttaacggttttttcggggtttaggacgttcgtaccgtttaagg

SEQ ID NO: 378013 - DNA, 561 bp, Homo sapiens
  misc_feature: GZ8MTXP02HPZ2U.39.14.B03.1.454.CMB.2.raw
  modified_base (424)..(424): a, c, t, g, unknown or other
  modified_base (465)..(465): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaacgtcggggtccgccgaggcctccggaggggaaggggcgtagggaggttgggtctcatccattagtcgtagtagttagttacatactactacgcagtactcagtaggaagggccatcactatctacaganacaacgaccaaagactcatcgtatctagacaaagtgaaacngcctagagacgaccgagaccgaggcttggtacttactacgtggtacgtaacggtaaggtttacggttttttcggggtagtagttcggtactttacg

SEQ ID NO: 378014 - DNA, 535 bp, Homo sapiens
  misc_feature: GZ8MTXP02ILH1X.39.14.B03.1.454.CMB.2.raw
  modified_base (221)..(221): a, c, t, g, unknown or other
  modified_base (302)..(302): a, c, t, g, unknown or other
  modified_base (338)..(338): a, c, t, g, unknown or other
  modified_base (531)..(531): a, c, t, g, unknown or other
  modified_base (533)..(535): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcatggaancagcagtgacgttggtggttataactatgtctcctggtaccaacagccacccaggcaaaacgcccccaaatcatgatttangaggctagaggacgaggctgattattactgcagctnattatacaagcagcagcactctgtgtagtcggcggagggaccaagctacggaccgtctaggtcacgtacccaaaggcccttcgaccccccgttgggtccctaccgtccttccgtttaccccaccccttccgtaccacgttacgtcgacctacgtcgtacggccgggtcgtcggcaacggggcgcaacgtaggncnnn

SEQ ID NO: 378015 - DNA, 643 bp, Homo sapiens
  misc_feature: GZ8MTXP02FIP5Y.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaacgtcggggtcccgccgaggcctccggaggggaacggggcgtgggaggttcgggtctcactcctatttagtcgtagtagttagttacattactactacgcagactcgagtagaacggggcctattccaacctatccctacccgaaggaacgaaacccgaaccgacccaaaagtaaacctcaaccgttagtactacctagaaccaaaagtacgaaaactacggacctaggaacgacggacccggaaggaccgaaccgggtctaggttacgttaacgtttacgtggttacgtaacggtaaggtttttacggttttttacgggggttttaggaacgtttcgacctttaaagg

SEQ ID NO: 378016 - DNA, 588 bp, Homo sapiens
  misc_feature: GZ8MTXP02JTVEP.39.14.B03.1.454.CMB.2.raw
  modified_base (262)..(262): a, c, t, g, unknown or other
  modified_base (283)..(283): a, c, t, g, unknown or other
  modified_base (293)..(293): a, c, t, g, unknown or other
  modified_base (322)..(322): a, c, t, g, unknown or other
  modified_base (330)..(330): a, c, t, g, unknown or other
  modified_base (583)..(583): a, c, t, g, unknown or other
  modified_base (586)..(588): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtgttataactatgtctctgtaccangcaccagcaaacgccccaaancatgatttangagctggaggacgaggctgatttattacngcagctanatatacaagcagcagctacttcttgtggttacgttcgggacgggacgggaacccaaggtccgtacggtaaccccgttcgtacgggtccaaccgggcccgaaaggcccgttaccggccccccgttcgggtccctaccgttcccgttccgtttccccccgtcccttccctaccgtaaccgttcggttacgccggtaaccgttcgggaacgggccggggtccgtacgggaccggaacgggccgaacggtagtacgngcnnn

SEQ ID NO: 378017 - DNA, 692 bp, Homo sapiens
  misc_feature: GZ8MTXP02HHZ76.39.14.B03.1.454.CMB.2.raw
  modified_base (285)..(285): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaggtgtccagtgtgaggtgcagctggtggagtcgtgggggagcgtggtcaagccgtgggggtccctgagactctcctgtgcagcctctggattcaccttcagtagctanagcatagaacgtcgggtcccgccgaggcctccggaaggggaacggggcgtgggaggttcgggtcctcgactccgtagttacgttccgtaagtagttaagttactattactacgtaacgctacgtacctcgaagtaggaaaccggggcctacgttaccgacctacttccgtaccgaagtaacgaacccaaccgaaccgaaaacgacctacctaacgttacggttacttaccgtaggaaacctaaaacgtacgaaaccgtacggtacccaggaaccggaacgacccggtaaacggacccggaacggtccttaggttacgttaaacgtttccgtaggttcggtaaccggtttaaggttttacgggtttttttcggggtttaaggtacggtttacggacccgttttaaagg

SEQ ID NO: 378018 - DNA, 545 bp, Homo sapiens
  misc_feature: GZ8MTXP02FQWQ3.39.14.B03.1.454.CMB.2.raw
  modified_base (450)..(450): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaccttcagtagctatagcatgaactgggtccgccaggctccgaggggaaggggctggagtgggtctcatccattagtcgtagtagtagttacatatactacgcagactcagtgaaagggccattcacatcctccagagacaacgaccaaagaactcatgtatctagacaaatgaaacngacctaggaagacgaccggaaggaccacgggtctaggtagttacttacgtgtcgcgtagttaggtttttacgggttttaggagttcggccttaag

SEQ ID NO: 378019 - DNA, 590 bp, Homo sapiens
  misc_feature: GZ8MTXP02I5W8T.39.14.B03.1.454.CMB.2.raw
  modified_base (373)..(373): a, c, t, g, unknown or other
  modified_base (381)..(381): a, c, t, g, unknown or other
  modified_base (452)..(452): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatcgcacgtgggtcccgccaggctccgaggggacggggctggaggtggtctcgactcccattagtagtagttctaagttacntatcttangcagcctcagtcgaaggccctatcaccatcctacaggacgaccgacgaccaaagtactcgtagttctttanacgacaaaagtcgaaacagcctaggacgacgacccgtaagggaccaccgggttcttaccgttttaataccgtggtacgtaacggaacggtaaggtaacggggttaactaaaacggggtaccctttaacgtaaacccgg

SEQ ID NO: 378020 - DNA, 585 bp, Homo sapiens
  misc_feature: GZ8MTXP02FW5HE.39.14.B03.1.454.CMB.2.raw
  modified_base (303)..(303): a, c, t, g, unknown or other
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtagttaacaactatgtctctggaccaacaaccaccccgacaaacgcccccgaagtcatgatttangacgtcaactaatcggccctcgaggggtgtctaatcgtcttcctcgtcgctcaagtctggcaacaccggtcctccctgacctatctcgtggcctcgaggctagaggacgaggtctagtattagttactcgcacgctcaattatacaagctaagttaaacttcgtacgtttccgtttacggggacgggtacggaaaccgagaccgttacgtacccgttacgtacggtaccgaacggtacccgtaacggttccccgcccccgttacggtccctacgtttccccg

SEQ ID NO: 378021 - DNA, 765 bp, Homo sapiens
  misc_feature: GZ8MTXP02IKYJU.39.14.B03.1.454.CMB.2.raw
  modified_base (179)..(179): a, c, t, g, unknown or other
tcagtcgcactagtcacgaccggtgctcgatttagtgtgagtagttccgcgggggcggtctcaggaggcagcgctctcaggacatctccaccatggcctgggctctgctgctcctcaccctcctcactcagggcacagggtcctgggcccagtctgccctgactcagcctgcctccgtntctgagactcctggacagtcgatcaccatctcctgcactggaaccagcagtgacggttggtgtacttatattatgttctcctggttaccaaacagctattacgaggtcacggacccgacccccgtaaacttctttaaaattttagtaggtacggtttccgtttccggtcccggtacccgttacggtacggggttttctaccggttccgtcctttccgtcccggtcgttacccgtaaggttccgtacgggaccaaaaccggtcccggtaccccttacccgtacgtaccctacgttacccgtacgtaaccgtacccttacccggaacggtcgttaacggaacgggacccggtagggtaccttaggtaactttaagtttacgtttggaccgtacgttactactaaatttaacgtaacgttagtaaacggttacctaaaggtttcgtaaaccttccgtacgtttcgggtcctttacgggggttaccgggtacggggtaaccggggtaaaaccgttaaacggggtttccggtaaccccggttaacggttacgggtacccgaaccgggtaccccgttaaccgggtcccccgg

SEQ ID NO: 378022 - DNA, 636 bp, Homo sapiens
  misc_feature: GZ8MTXP02JTUO3.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcacgcctctggacttccaccttcagtagctatacgcatgaacgtcgggtcccgccgaggcctccggaaggggaacggggcgtgggaggtcgggtctcgactcctagtttacgtcgtagtagttagttacattactactacgcagactacgagtaggaacgggtcctattcccaacctatccctacgaagaacgaaccaaccgaccaaagaacctcaacttgtactcctagaacctaaaagtacgaaaccagtacccgtaggaaacgacggacccggaaggacccgagggttactaggttaacgttacttaccgtggtacggtaacggttaggtttttacgggttttttacgggtttagacggtttccgacgtttaagg

SEQ ID NO: 378023 - DNA, 549 bp, Homo sapiens
  misc_feature: GZ8MTXP02I4MHM.39.14.B03.1.454.CMB.2.raw
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggacaaagtccccaaactgatgatttatgaggtcaactaaaacggccctcgaggggtttactaatcgtcttcctctggctcaagtctgcaacacggcctccctgaccatctctggctccgagctgaggacgaggctctctattattgcagctactataataacaagactaattactactacgttggtcgttcggcgggtacgggacccgaacgtcggtaccgttacgttacggtacaacggcccgaaaggcctccgcccccgtcggtacctacccg

SEQ ID NO: 378024 - DNA, 682 bp, Homo sapiens
  misc_feature: GZ8MTXP02G0QZ8.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactgggctccgctggttttccttgttgctattttagagtgtccagtgtgaggtgcagctggtggagtcgtgggggagccgtggtcaagccgtgggggtccctgagactctcctgtgcacgccccgtggacttcaccttcagtagctatagcatcgaacgtcggtcccgccgacggcctaccggaggggtaacggggtcgtaggggtaggttcggggtcctcgtacgtaccgtagtttacggtacggttaagttagttaacgtttaactattaacttaccgtaaccgacgtaacgtacctacgtaaggtacggaacgggtacccgtaactttcccaaccgtacgtcctacccgaaagtaccgaacaaacccgaccaaacgtacctacactagtactactacgtactaaatacgaacacgaccgtagacggacgccggaaggaccgtacggtcttaggttagttaacgttacgtgtacggttacgttaagggttttaacggttttttcgggtttaggtacggttaccgtaccgttagtttaaccgg

SEQ ID NO: 378025 - DNA, 545 bp, Homo sapiens
  misc_feature: GZ8MTXP02JJQ9D.39.14.B03.1.454.CMB.2.raw
  modified_base (303)..(303): a, c, t, g, unknown or other
  modified_base (378)..(378): a, c, t, g, unknown or other
  modified_base (458)..(458): a, c, t, g, unknown or other
  modified_base (508)..(508): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgaactgggtccncgaggctccggaggggaagggctgggagtgggtctcgatccagttcgtcgtagtagttagtacattatactacgnagactcaagtggaacgggctattcacatcctacagagaacacgacaaagactctatcgtatctagaacaaatcgaaaacngcctaggacgacgcggaacggcgaacggcttgtactagttacgtgtacgngtaggtttagttttcgggtttagcgttcgacttaagg

SEQ ID NO: 378026 - DNA, 560 bp, Homo sapiens
  misc_feature: GZ8MTXP02I497Z.39.14.B03.1.454.CMB.2.raw
  modified_base (304)..(304): a, c, t, g, unknown or other
  modified_base (399)..(399): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattccaccttcagtagctatagcatgaactgggtccncgaggctccgaggggagggctggagtggtctcatcctattagtcgtagtagttagttacatatactacgcagactcgagtgaagggcctatcacntcctacagacacaacaccaaagactcatgtatctgaactaaatcgaactcgacctaggaacgacggacccggaggaccgaccggcttaggtagttacttacgtggtacggtaacggttaaggtttacggttttttcgggttaggtagtcgtaccgtttaag

SEQ ID NO: 378027 - DNA, 658 bp, Homo sapiens
  misc_feature: GZ8MTXP02HDY4N.39.14.B03.1.454.CMB.2.raw
  modified_base (294)..(294): a, c, t, g, unknown or other
tcagtcgcactagtcacgaccggtgctcgatttagtgtgagtagttccgcgggggagctctgagagaggagccttagccctggattccaaggcctatccacttggtgatcagcactgagcaccgaggattcaccatggaactggggctccgctgggttttccttgttgctattttagaaggtgtccagtgtgaggtgcagcgtggtggagtcgtgggggaggcctggtcaagccgtgggggtccctgagactctcctgtgcacgcctctggattccaccttcagtagctatagnatagaacgtcgggtcccgccgacggcctaccggaggggaacggggcgtgggaggtggtctcactcctagttacgtacgtagtagttagttacatatactacgacagactcagtagacgggcctatcactatcctacgagaacaaccaacgaccaaaagaccctactaacgtcttaacgtcgtacgaaaccaaaagttacgaaaccgaccggtacgtacggaaacgggaaacggccccggtaaaaggcccggaacggtcgttaggttaacggtttacttaaccggtggttaacgggaacggtttaaggggtttacgggttttttttaccggggtttagggaacgtttcggtaacccgtttaacgg

SEQ ID NO: 378028 - DNA, 586 bp, Homo sapiens
  misc_feature: GZ8MTXP02GFXIL.39.14.B03.1.454.CMB.2.raw
  modified_base (418)..(418): a, c, t, g, unknown or other
  modified_base (526)..(526): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgaactcgggtccgccaggctccgaggggaaggggctgggaggtggtctcatccattagtcgtagtagtagttacagtatactacgctagactcagtgaaacggggcctattccactagtctacaganaaccaacgaccaaagactacactagtactcagtaacaaaagtgaaacacggtaccaggaacgacggacccggaaaggaccgcgggtacttggttaacgttagttacgnggttcggaacggttaggtttacggttttttcggggtttaggacgtttcggtactttaagg

SEQ ID NO: 378029 - DNA, 613 bp, Homo sapiens
  misc_feature: GZ8MTXP02IVADB.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctcgtgattcacttcagtagctatagcagtgactgggtcccgcaggcctccgaggggagggcgtggagtgggtctcatcctattacgtcgtagtagttagttactatatactacgacgacgactcgaaggtaggaaacgggggtccatttccaaccctaatctaccgaagaacgaacaaacccgacaaacgaacctactacgtacgttctaccgttagaaccgtaaaaattcggaaacacggtccgtaaggacggacgacccggtaagggacccacgggtcttagggttacgttaagttaccgtggttacgcggaaaggaacggttagtaccgaaggacggtaacgttaag

SEQ ID NO: 378030 - DNA, 808 bp, Homo sapiens
  misc_feature: GZ8MTXP02GSJRQ.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggacttctaccttcagtacgctatagcatagaacgtcggggtacccgccgacggaccctccggaagggggaaggggccgtaggggtaacgggttcgggttacctaccgacttacccgtaagtttacggttaccggttaaaggttaacggtttaacgttaaacctaaagtttaccgttaaaccgttaaccggtaccgtaacggtaacctacggtaagggttacggggaaaacggggtcccttaaaacgttccaaaccccgtatcccgttacccgaaaggacgaaaccccgtaaacccgacccgaaaaacggtaaaccctcctaaaccgttacggttaactcccgttaaggaaacccaaaaagttacggaaaccctaggtaccccgtagggaaaaccggtacgggaaccccggtaaacgggtaaaccccgcggggtaacctttaggtacggtttaaactttacccggtggtaccggaacgggtttaaagggtttttcgggtttttttaccggggtttaggacggtttaccggttaccgttaaagg

SEQ ID NO: 378031 - DNA, 639 bp, Homo sapiens
  misc_feature: GZ8MTXP02IS466.39.14.B03.1.454.CMB.2.raw
  modified_base (309)..(309): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggagcctggtcaaggccgtggggggtccctgagtactcgtcctgtgcagcctcgtggattcaccttcagtagctatagcatgaactgggtccnccgaggctaccgaggggaacgggtctagggagtcgggtctacgagtcctagttacgtcgtaagtagtacgttaccgattacgtacctacgactagactcgaaggttaggaaacggggtccctaaattcccgaacctacttcccgtaccgagaacggaacaaaccgggcccaaaaggtacctacgaacttggttaacttcgacgacaaagtcggaacaacggccgtagacgacggaccccgaaggacccgtacggtcgtgtaacgtttactaccgtggacgtaacggttagttaccggggttttttacggttagacgttcggtaccttagg

SEQ ID NO: 378032 - DNA, 578 bp, Homo sapiens
  misc_feature: GZ8MTXP02GXOVR.39.14.B03.1.454.CMB.2.raw
  modified_base (304)..(304): a, c, t, g, unknown or other
  modified_base (376)..(376): a, c, t, g, unknown or other
  modified_base (456)..(456): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagctctcctgtgcagcctctggattcaccttcagtagctatagcatgaactgggtccnccaggctccgaggggaagggctggagtgggtctcatccagttagtcgtagtagtagttacattatactacgnagctcgagtgaaacgggccattcacatctacagacgacaacgctaaagaactcaactgtatctagactaaaatcgaaacngtccagaacgagaccccgaaaggaccgaaccggggttcttaggttacgtttaacgttacgtggtacggtaacggttaaggttttacggggtttttacgggttttaggacgttcgtacgtaag

SEQ ID NO: 378033 - DNA, 717 bp, Homo sapiens
  misc_feature: GZ8MTXP02INUWO.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactgggctccgctgggttttccttgttgctattttagaaggtgtccagtgtgaggtgcagcgtggtggagtcggtgggggaggccgtggtcaagccggtgggggtccctgagactctcctgtgcacgcctcgtggtacttcctaccttacgagtacgactaagtacgactagtagtaaccggtccggggtcccgaccggacggtacccgacccgggaagggggaacggggtcggtaggggtacggtcgggtctacgtaccttacgtaacgtttacggtacggttaaggttacggttaacgttaactaacttacgtaaccgtaaccgacgtaagtaccttacgaaggtacgggaaccggggtacctattacccaacctactacccgtaccgaagaaccgtaaaccgaaaccgaccgaaaacgtaactaccaaccgttagttactcgtaacgaaataaacgtacgaactacgacgtacgaacggcgaaccggaacgacgaccggtctaggttacgttacgttcgtagtacggtaacgttaaggttttcggtttttcgggtaggtacgtacgtacttaacgg

SEQ ID NO: 378034 - DNA, 815 bp, Homo sapiens
  misc_feature: GZ8MTXP02GTFCI.39.14.B03.1.454.CMB.2.raw
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgcttgggttttccttgttgcttattttagaggtgtccagtgtgaggtgcagcgtggtggagtcgtgggggagcctggtcgaagccggtgggggtccctgacgactctccgtgtcgcagcctcgtgtacttcctaccttcgagtagctagtagcataggaacgtcggggtccccgaccgacgggcccgtaccggaagggggaacggggtccgttaggggagggttcgggtacctacgtaacgttacccgtaagtttacggtaccgtttaaaggttaaggttaaacggtttaaccctaagtttaccgttaaacccgttaaccggaaccgtaacgtaacccgttacggtaaacgggtacggggtaaaaccgggggtccccttaaaactttcccgaaaccccgttattcccccgtaacccgaaaaggaaccgaaaccccgaaacccgaacccgtaaaagtaaaccctaccgtaaccttaggttaacctaccggttaacgaaactaaaacgtacgaaaacctcgacccgaaggaacgggacccggaaccggtaacgggacctaccgggtaccgtttaggtacgtttaaccgttacgtgggttaagttccggttaaaggtttttcggggtttttttaccgggttaggacgtttaccggtaccgtttaaaggg

SEQ ID NO: 378035 - DNA, 750 bp, Homo sapiens
  misc_feature: GZ8MTXP02GRKI4.39.14.B03.1.454.CMB.2.raw
  modified_base (674)..(674): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactgggctccgctgggttttccttgttgctattttagaaggtgtccagtgtgaggtgcagcgtggtggagtcgtgggggagcctggtcaagccgtgggggtccctgagactctcctgtcgcacgcctcgtggtacttccaccttcagtagctaatagcagtagaacgtcgggtcccgaccgacggtcctaccggaaggggaacggggtccgtaggggtacggttggggttacctaccgtacgttaccgtaagtttacgggttaccgttaaaggttaaggtttaagtttaaaccgtaaatttacgttaaccgtaaacggtaccgtaacgtaaccgtaccgtaaagggttacgggaaaacggggtcccttaattacccgaaaccccgtaattccccgtaacccaaagggtaaccaaaacccgaaacccgaacccgaaaaaggtaaaccctccgtaaacgtttaggtaacttcctaaaggaacctaaaagtagaaaccgacgtaccgtaggaagaccgaccggaacggacgtaccggtnttacggttaacttacgttacggtgtacggtaacgtttagggttttacggtttttcgggttagacgttcgtactagg

SEQ ID NO: 378036 - DNA, 694 bp, Homo sapiens
  misc_feature: GZ8MTXP02IH244.39.14.B03.1.454.CMB.2.raw
  modified_base (211)..(211): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgagattcaccatggaactgggctccgctgggttttccttgttgctattttagaaggtgtccagtgtgaggtgcagctggtggagtcggngggggagcgtggtcgaagccgtgggggtcctgacgtactctcgtgtgcacgcctcgtggacttccacttacagtagactatacgactatagacgtcggggtacccaccgacggtcctaccggaaggggaagggtcgtaggggtagtcgggtactcacgtacctagttacgtacgtagtacgtagttacatactactacgcctaagtacctcgaagtcgggaaacggtacctaacttaccgaacctattacccgtaacgaacggaacgaaaccgaaaccggaacctaaaacggaaaccttaaccgtaacttacgtaacttaccgtagtaaacgaaagttacgaaactacggaccgttaggaacgacgaaccggtaacggacgtaacgggtacttgggtaacttagttaaccgttggtacggtaacggttttacggtttaacgggtttttacgggtttaggtacgttacgttaccgtttaaacgg

SEQ ID NO: 378037 - DNA, 691 bp, Homo sapiens
  misc_feature: GZ8MTXP02FMNTW.39.14.B03.1.454.CMB.2.raw
  modified_base (247)..(247): a, c, t, g, unknown or other
  modified_base (333)..(333): a, c, t, g, unknown or other
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtgtataactntgtctctgtaccaacatccaccagcaaacgccccaaactgatgatttatgagtcaactaaaccggcctacgtagggttacaagtcnccttctctgcctactaagtctggacaaacgaccggtccctaccctcgaccactctcgtcggcctaccgaggcgtagacgggacgacggtcctacgttacttaactttaagttcgacgtacgtaccttacgtaaacttaacgtaaaccgtaaagtaccttaaactttacgtaccgtttaacgggttttcgggggtttacggtttacccgggggcggggttaaaccgggtaaaccgggttaaacggtttccggggtaaacccccggttccgttaaacggggttaaccgtaacccggaaccccggtaaaaccggggttccccgtttacccggtaccccccccggttcgggtttaacccccg

SEQ ID NO: 378038 - DNA, 631 bp, Homo sapiens
  misc_feature: GZ8MTXP02FTBS1.39.14.B03.1.454.CMB.2.raw
  modified_base (519)..(519): a, c, t, g, unknown or other
  modified_base (527)..(527): a, c, t, g, unknown or other
  modified_base (530)..(530): a, c, t, g, unknown or other
  modified_base (536)..(536): a, c, t, g, unknown or other
tcagtcgcactagtcacgaccggtgctcgatttagtgtgagtagttccgcggggagctctgagagaggagccttagccctggattccaaggcctatccacttggtgatcagcactgagcaccgaggattcaccatggaactggggctccgctgggttttcctgttgctatttagagtgtccagtgtgaggtgcagcgtggtggagtcgtgggggaggccgtggtcaagccgtggggggtcccctggagactctcctgtgcagcctctggattcaccttcagtagtctatacgcagtgaaacgtcggggtcccgccaggcctaccgaagggggaaggggtccgtaggggtacgggttggggtaccttcggaactcctaagtttacggtacggttaaggttaacggttaagtttaaccaagttactaaccgtaaccggcaacggtacttacgaagtagggaaacgggtccgaattcaacctaacttcgaccagacgtaacaccgaactaagaactcacttnatacgtanaanaaaganacagcgagagacgacgacggacgacgtcgtgtagttacgtacgtacgtagtaagttaggtttacggttttcggttaggttacgtacgtacgtacg

SEQ ID NO: 378039 - DNA, 700 bp, Homo sapiens
  misc_feature: GZ8MTXP02FUEAO.39.14.B03.1.454.CMB.2.raw
  modified_base (264)..(264): a, c, t, g, unknown or other
  modified_base (631)..(631): a, c, t, g, unknown or other
tcagtcgcactagtcacgaccggtgctcgatttagtgtgagtagttccgcggggagctctgagagaggagccttagccctggattccaaggcctatccacttgttgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctntggattcaccttcagtagctatagcatgaacgtgggtcccgccgaggcctaccggaggggaacggggccgtaggggaggttcgggtcctcgacttcctaagtttacgtacggttaagttacggttaagttaaccgtaattacttaaccgtaacggactaaacgtaccttacgaagggtacgggaaacgggggtccctaactttccaaacctattccctaccgagaacgaaaccaaccggaccaaaacggaaccttaccgacttaggttaactccgttaagaacctaaaagtcgaaacgtacgtccgaaggacgacggacccgtaaagggacccgtacggtaccttggttacgtttaacgtttaacgnggttacggaacggtttaaggggttttacggtttttcggggttttaggacggtttccgaccgtttaacgg

SEQ ID NO: 378040 - DNA, 534 bp, Homo sapiens
  misc_feature: GZ8MTXP01A7N11.38.26.C04.1.454.CMB.2.raw
tcagtcgatcacgtcacgaccggtgctcgatttagtctagcgactttgggtttgggatggtttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgaatatcgtggggccaaaggggacaagtgggtcaccgtctcctcagcctccaccaacgggcccatcggtcttcccctgcaccctcgtcagacgcacctcgtggggcacagcggcctgggctgccttggtcaggactacttccgacgttgaatcgaactgagcggcgttggcg

SEQ ID NO: 378041 - DNA, 559 bp, Homo sapiens
  misc_feature: GZ8MTXP01EJ7X0.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccaggggctcggtggtaacgttaggtgtcttttgaattatcgtgggggaccaaaggggacaagttcgggctaccgtctcctcacgcctccaccgaacgggcccactccggtcttcccctggccaccctcctccaagacgccacctcgtggggcacgcgccggcccgtgggctgccttggtcaacggactacttccgcgttgaatcgaactgagcgggcgttggcg

SEQ ID NO: 378042 - DNA, 524 bp, Homo sapiens
  misc_feature: GZ8MTXP01AEIVO.38.26.C04.1.454.CMB.2.raw
  modified_base (438)..(438): a, c, t, g, unknown or other
  modified_base (520)..(520): a, c, t, g, unknown or other
tcagtcgatcacgtcacgaccggtgctcgatttagtctagcgactttggttgggatggtttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagagagggggccaggggctcggtggtaacgttaggtgcttttgaatatctggggccaaaggggacaatgggtcaccgtctcctcagcctccacaagggccatcggcttcccctggcacccncctcaagagcacctcgtggggcacgagcggccctgggctgccttggtcaggctacttcgacgttgaatcgaactgagcggcnggcg

SEQ ID NO: 378043 - DNA, 565 bp, Homo sapiens
  misc_feature: GZ8MTXP01DD771.38.26.C04.1.454.CMB.2.raw
tcagtcgatcacgtcacgaccggtgctcgatttagtctagcgactttgggtttggggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagagagggggccaggggctcggtggtaacgttaggtgtcttttgaattagtcgtggggaccaaagggacaagtcgggtcaccgtctcctcacgcctccaccaacgggcccagtccggtccttcccctggccacccctcctccaacgacgacaccgtcgtcggggcacgacgccgcccgtcgggctcgccgttggtcaacggactacttccgacgttcgaatcgaactgagcgggcgttggaacg

SEQ ID NO: 378044 - DNA, 617 bp, Homo sapiens
  misc_feature: GZ8MTXP01CNRC6.38.26.C04.1.454.CMB.2.raw
tcagtcgatcacgtcacgaccggtgctcgatttagtctagcgactttgggtttgggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgtcttttgaattatcgtggggaccaaaggggacaagtgggtcaccgtctcctcagcctccaccaacgggcccactccggtccttcccctcggccacccctcctccaacgacgccaccgtccgtcgggggcaccgacggtccggccccgtcggggccttcggcccgttgggttacccgaaacgggtaccttaacccgtttcccgaaccggttcgaacgttccggaacgttcgggacggccgggggccgttcggggaaccgg

SEQ ID NO: 378045 - DNA, 602 bp, Homo sapiens
  misc_feature: GZ8MTXP01CPD0D.38.26.C04.1.454.CMB.2.raw
  modified_base (277)..(277): a, c, t, g, unknown or other
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatgganatgaagtagcctgagatctgacgacacggccgtgtatttcngtgcgagaggagggggccaggggctcgggtaggtaacgttaggtgtcttttgaaattagtcgtggggaccaaaggggacaaagtcggtaccaccgtctcctcacgcccaccacccgaacggcccctacgtccggtcccttcccccgtcggacccacccctcctaccaagacgccaccgtcgcggggcacgacgccggcccgtcggcgtcgccgttcggtacgaaacggtaccttaccgttccgacgttcggaatccgaacgtggacggcgggtccggcggaacg

SEQ ID NO: 378046 - DNA, 544 bp, Homo sapiens
  misc_feature: GZ8MTXP01DSCBS.38.26.C04.1.454.CMB.2.raw
  modified_base (320)..(320): a, c, t, g, unknown or other
  modified_base (442)..(442): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcaacagtctacatggagatgagtagcctgagatctgaacgacacggccgtgtatttcngtgcgagaggagggggccagggggctcggtggtaacgttaggtgtcttttgaatatcgtggggaccaaaggggacaagtggtcaccgtctcctcagcctccacaaggccatcgtcttccccngccaccctctccagacgcacctcgtggggcacgcgccgcccgtgggctgccgttggtcaaggctacttccgacgttgaatcgaactgacgcggcttggaacg

SEQ ID NO: 378047 - DNA, 558 bp, Homo sapiens
  misc_feature: GZ8MTXP01COK3P.38.26.C04.1.454.CMB.2.raw
  modified_base (547)..(547): a, c, t, g, unknown or other
  modified_base (555)..(555): a, c, t, g, unknown or other
  modified_base (557)..(557): a, c, t, g, unknown or other
tcagtcgatcacgtcacgaccggtgctcgatttagtctagcgactttgggtttgggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccagagcacagtctacatggagatgagtagcctgagatctgacgacacggccgtgtattctgtgcgagaggagggggccaggggctcggtaggtaacgttaggtgtcttttgaattatcgtggggaccaaagggacaagtggcaccgtctctcacgcctccaccgaaacggcccacgtcggtcccttccccgcggccacccttccgaccaaacgacgccacctcgcgggggccacgacgccgcccgtgggctcgaccgttggacaacggactaacttccgcgttgaatcgaacgngcgcgcgngng

SEQ ID NO: 378048 - DNA, 559 bp, Homo sapiens
  misc_feature: GZ8MTXP01DPKZK.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagagagggggccagggggctcggtggtaacgttaggtgcttttgaattatcgtggggccaaaggggacaagtgggtcaccgtctcctcacgcctccaccaacgggcccatcggtccttcccctggccacccctcctccaagacgccacctcgtcgggggcacgacgccggcccgtgggctcgccttggtcaaggactacttccgcgttgaatcgaactggacgcgggcgttggaacg

SEQ ID NO: 378049 - DNA, 533 bp, Homo sapiens
  misc_feature: GZ8MTXP01A71SG.38.26.C04.1.454.CMB.2.raw
tcagtcgatcacgtcacgaccggtgctcgatttagtctagcgactttgggtttgggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgtcttttgaatatcgtggggccaaaggggacaagtggtcaccgtctcctcagcctccaccaacgggcccatccggtcttcccctgcaccctctcagcgcacctcgtggggcacgagcgcctgggctgcttggtcaggctacttccgcgttgaatcgaactgagcggcgttggaacg

SEQ ID NO: 378050 - DNA, 551 bp, Homo sapiens
  misc_feature: GZ8MTXP01ARNPC.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccagggggctcggtggtaacgttaggtgcttttgaatatctggggcccaaggggcaatggtcaccgtctcctcagcctccaccaagggcccatcggtcttcccctggcaccctcctccaagacgccacctcgtcgggggcacgacgcggccctggggctggcccttgggtccaagggacctacttcccacgttcgaatcgaactgagcgggcttggcg

SEQ ID NO: 378051 - DNA, 533 bp, Homo sapiens
  misc_feature: GZ8MTXP01C594J.38.26.C04.1.454.CMB.2.raw
  modified_base (467)..(467): a, c, t, g, unknown or other
tcagtcgatcacgtcacgaccggtgctcgatttagtctagcgactttgggtttggggatggttttctcgatggggactgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagagagggggccaggggctcggtggtacgttaggtgcttttgaatatctggggccaaagggacaatggtcaccgtctcctcagcctccacaagggcccatcggcttcccctgcaccctctccaagacgcacctcgtgggggcacngccggccctgggctgcccttggtcaaggctacttccgagttgaatcgaactgagcgggcttgggcg

SEQ ID NO: 378052 - DNA, 604 bp, Homo sapiens
  misc_feature: GZ8MTXP01AMKFX.38.26.C04.1.454.CMB.2.raw
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttcngtgcgagaggagggggccaggggctcggtggtaacggttaggtgtcttttgaattagtcgtggggaccaaaggggcaagtcgggtcacccgtctcctcacgccctccaccaacgggcccacgttccggtcccttcccccgtcggccctacccctccctacccaaacggacgccaccgtcgtcgggggccaaccgcgtccggcccgtcgggcctcggcccgttgggtaccaaaggtaccctaaccttccgacgttcgaactcgaacgtgacggcgggtccgcggaacg

SEQ ID NO: 378053 - DNA, 538 bp, Homo sapiens
  misc_feature: GZ8MTXP01BPE67.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtccccctgcaaggcttctggaggcaccttcagcacctatactttcagctgggtgcgacaggccccctggacaagggcttgagtggatgggagggatcctcccgatctttggcaaaccacacctacgcacacaagttccaggcagactcacgattaccgcgacgaactccacgagcacagtactacatggagatgagtagccgtgagatctgacgacacggccgtgtattctgtgcgagaggagggggccgaggggcttcgggttggttaacggttaaggtgtcgttttgattagtcgttggggaaccg

SEQ ID NO: 378054 - DNA, 576 bp, Homo sapiens
  misc_feature: GZ8MTXP01BB5VD.38.26.C04.1.454.CMB.2.raw
  modified_base (375)..(375): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgagatgaagaagcctgggtcctcggtgaaggtcccctgcaaggcttctggaggcaccttcagcacctatacttcagctgggtgcgacacggcccctggacaagggcttggagtggagtggggaggactcccgtccgattctttggacaaaccaccactacgcacacaaacgttccnggacagactcacgactaccgcgacgatccacgagcacagtctacatggagatagagtagctgagatcagacgacgacggccgttgttactttcgtggtggcggttagggacgggacggggggcccgaagggggttccgttcggggttagggttaaccgggtttgggtggttcgttttggagttaacgttcggtaacggggg

SEQ ID NO: 378055 - DNA, 531 bp, Homo sapiens
  misc_feature: GZ8MTXP01BJ1W2.38.26.C04.1.454.CMB.2.raw
  modified_base (420)..(420): a, c, t, g, unknown or other
  modified_base (461)..(461): a, c, t, g, unknown or other
  modified_base (510)..(510): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatccctcccgatctttggacaaaccacacctacgcacacaagtacccaggcagactcacgataccgcgacgaatccacgagcacagtactacatgganatgagtagcgtagagatcgtgacgacacggccgtgtattcngtgcgagaggacggggcgaggggcttcgggttggttacgttaaggtgtntttgattagtcgttgggaacg

SEQ ID NO: 378056 - DNA, 593 bp, Homo sapiens
  misc_feature: GZ8MTXP01ASWCN.38.26.C04.1.454.CMB.2.raw
  modified_base (278)..(278): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacacggccgtgtatttctgtgcgagaggagggggccaggggctcggtggtaacggttaggtgtcttttgaattagtcgtggggaccaaaggggacaagtgggtcaccgtctcctcacgcctccaccaacgggcccatccggtccttcccccgtcggcctaccccgtcctccgaacgacgccaccgtcgtcgggggccacgcggccggcccgtcgggctcggccgttcggtacgaacggtaccttacgttcccgcgttcgaactcgaacgtggacggcgggtcgttgggaaccg

SEQ ID NO: 378057 - DNA, 557 bp, Homo sapiens
  misc_feature: GZ8MTXP01D7K6F.38.26.C04.1.454.CMB.2.raw
  modified_base (547)..(547): a, c, t, g, unknown or other
  modified_base (554)..(554): a, c, t, g, unknown or other
  modified_base (556)..(556): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggagggggccagggggctcggtggtaacgttaggtgcttttgaatatcgtggggccaaaggggacaagtgggtcaccgtctcctcagcctccaccaacgggcccatccggtccttccccctggccacccctcctacccaagacgccacctcgcgggggcacgacgtcggcccgtgggctgccgttggtccaaggactacttccgacgttgaatcgaactggngcggcgngng

SEQ ID NO: 378058 - DNA, 541 bp, Homo sapiens
  misc_feature: GZ8MTXP01AFC8S.38.26.C04.1.454.CMB.2.raw
  modified_base (444)..(444): a, c, t, g, unknown or other
  modified_base (472)..(472): a, c, t, g, unknown or other
  modified_base (518)..(518): a, c, t, g, unknown or other
tcagtcgatcacgtcacgaccggtgctcgatttagtctagcgactttgggtttggggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgaatatctggggcccaaggggacaagtggcacccgtctcccgtcagcctccaccgaagggcccatccggtcttcccccgnggccaccctccgtccaagcgcacctcgnggggccacagccgccctgggctgcccttgcagctacttccacgttnaatcgaacgtgagcggcttgggc

SEQ ID NO: 378059 - DNA, 557 bp, Homo sapiens
  misc_feature: GZ8MTXP01DWPET.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgaatatcgtggggccaaagggacaagtggtcaccgtctcgtcacgcctccaccaacgggcccatccggtccttccccctggccacccctcctacccaagacgccacctcgtcgggggcacgacgccggccctgggctcgccttggtcaaggactacttccgcgttgaatcgaactgagcgggcgttggaacg

SEQ ID NO: 378060 - DNA, 634 bp, Homo sapiens
  misc_feature: GZ8MTXP01EVLYM.38.26.C04.1.454.CMB.2.raw
  modified_base (450)..(450): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctcggtgaacggtcccctgcaaggcttcgtggaggcaccttcagcacctatactttcagctgggtgcgacgacggcccctggacaagggcttgagtggagtgggagggactcccgtcccgattcgtttaggaccaaaccacacctacgacacacaacgttaccagaacagactcacgtacgttaccgacggaacgaactcccacgacgcaacagtactaacgagtggaanatagaagtagccgtagaagattccgagaccgacgaccggtccgttagttacgtttccgtggtcggaacggtaagggaggggacgggggccgaagggggtccgttacgggggttacgggtttaaacgggtttaagggttggttcgttttaggtagttacggttccgggttaagggggtaacccgg

SEQ ID NO: 378061 - DNA, 534 bp, Homo sapiens
  misc_feature: GZ8MTXP01DLQJ4.38.26.C04.1.454.CMB.2.raw
  modified_base (319)..(319): a, c, t, g, unknown or other
  modified_base (445)..(445): a, c, t, g, unknown or other
  modified_base (453)..(453): a, c, t, g, unknown or other
  modified_base (471)..(471): a, c, t, g, unknown or other
  modified_base (509)..(509): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatcttttggcaaaccacactacgcacacaagttccaggacagactcacgattaccgcggacgaatccacgagcacagtctacatggagatgagtagcctgagatctgacgacacggccgtgtatttcngtgcgagagagggggccaggggctcggtggtaacgttaggtgcttttgaatatcgtggggccaaaggggacaagtggtcaccgtctctcagcctccacaagggcccatcgtctcccctgccacccncctcaagngcacctcgtggggcacgngcgcctggctgccttggtcaaggctacttccgcgttgntcgaactggagcgggcgttggaacg

SEQ ID NO: 378062 - DNA, 541 bp, Homo sapiens
  misc_feature: GZ8MTXP01CXNVX.38.26.C04.1.454.CMB.2.raw
  modified_base (277)..(277): a, c, t, g, unknown or other
  modified_base (317)..(317): a, c, t, g, unknown or other
  modified_base (458)..(458): a, c, t, g, unknown or other
  modified_base (466)..(466): a, c, t, g, unknown or other
  modified_base (475)..(475): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatgganatgagtagcctgagatctgacgacacggccgtgtatttcngtgcgagagagggggccaggggctcggtggtaacgttaggtgcttttgaattatcgtggggccaaaggggacaagtggtcaccgtctcctcagcctccaccaagggcccatcggtcttcccctgccaccctcctcaagacncacctcgnggggcacgngcggccctgggctgccttggtcaggtactcttccgcgttgaatcgaactgagcgggcgttggaacg

SEQ ID NO: 378063 - DNA, 563 bp, Homo sapiens
  misc_feature: GZ8MTXP01E0QZH.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggagggggccagggggctcggtggtaacgttaggtgcttttgaatatcgtggggccaaaggggacaagtggcaccgtctcctcacgcctccaccaacgggcccatcggtccttccccctcggccacccctcctccaaagacgccacctcgtgggggcacgacgccggccctgggctcggccgttggtacaaacggactaacttccgcgttgaatcgaactgacgcgggcgttggaacg

SEQ ID NO: 378064 - DNA, 539 bp, Homo sapiens
  misc_feature: GZ8MTXP01EZ9DV.38.26.C04.1.454.CMB.2.raw
  modified_base (520)..(520): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgtgagagagggggccagggggctcggtggtaacgttaggtgcttttgaatatctggggccaagggacaatgggtcaccgtctcctcagcctccaccaagggcccatcggtcttccccctggccaccctccgtccaagacgcacctcgtgggggcacacgcggcccgtggctgccttggtcaaggactacttccgcgttgntcgctgagcgggcttggcg

SEQ ID NO: 378065 - DNA, 547 bp, Homo sapiens
  misc_feature: GZ8MTXP01B6HEV.38.26.C04.1.454.CMB.2.raw
  modified_base (526)..(526): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccagggggctcggtggtaacgttaggtgctttgaatatcgtggggccaaaggggacaatgggtcaccgtctcctcagcctccaccaaacgggcccatcggtcttccccctggccaccctcctccaacgacgcaccctctcgggggcacacgcggccctgggctgccttggtcaaggactacttccgacgttgntcgaactgagcgggcttggcg

SEQ ID NO: 378066 - DNA, 562 bp, Homo sapiens
  misc_feature: GZ8MTXP01ACSCO.38.26.C04.1.454.CMB.2.raw
  modified_base (329)..(329): a, c, t, g, unknown or other
  modified_base (473)..(473): a, c, t, g, unknown or other
  modified_base (533)..(533): a, c, t, g, unknown or other
  modified_base (538)..(538): a, c, t, g, unknown or other
  modified_base (556)..(556): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggngggggccagggggctcggtggtaacgttaggtgcttttgaatatcgtgggggcccaaaggggacaagtgggtcaccgtctcctcacgcctccaccgaacgggcccatccggtccttccccctggccacccctcctcccaagacnccacctcgtcgggggccacgacgccggccctgggctcgccttggtcaaggctacttccgnggttnaatcgaactgaggcggcnggaacg

SEQ ID NO: 378067 - DNA, 542 bp, Homo sapiens
  misc_feature: GZ8MTXP01A296X.38.26.C04.1.454.CMB.2.raw
  modified_base (418)..(418): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtgcgacaggcccctggacaagggcttgagtggagtgggagggatcccgtccgatctttggacaaaccacacctacgcacacaagttcccaggcagactcacgattaccgcgacgatcacgagcacagtctacatgganatagagtagccgtgagatcgtagacgacacggccgtgtatttctgtggcgagaggagggggccgaggggtcgttcggggttggttaacggttgggtgtcgttttgattagtcgttggggaaccg

SEQ ID NO: 378068 - DNA, 553 bp, Homo sapiens
  misc_feature: GZ8MTXP01EDRBD.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccaggggctcggtggtaacgttaggtgcttttgaatatcgtggggaccaaagggacaatggtcaccgtctcctcagcctccaccaacgggcccagtccggtccttccccctcggcctacccctcctccaagacgcacctcgtcgggggcacgacgcggccctgggctgccttggtcaaggactacttccgacgttgaatcgaactgagcgggcttggcg

SEQ ID NO: 378069 - DNA, 625 bp, Homo sapiens
  misc_feature: GZ8MTXP01B42B5.38.26.C04.1.454.CMB.2.raw
  modified_base (319)..(319): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgattctttggcaaaccacactacgcacacaagttccaggacagactcacgattaccgcgacgaatccacgagcacagtctacatggagatgagtagcctgagatctgacgacgacggcgtgtatttcgngtgcgaggaggagggggccaggggctcgggtaggtaacggttaggtgtcttttgaattagtcggtggggaccgaaaggggacaagtcggtacaccgtctcctcacgccctccgaaccgaacgggcccacgtccggtcccttcccccgtcggcctacccctcctacccaacgacgacccaccgtccgtcgggggaccacgacggcccggcccgtcggggcctcggccgttgggtaccgaacgggtaccttaccgttccgacggttcgaagttccgaacgtcggacggccggggtcgttcgggaaccg

SEQ ID NO: 378070 - DNA, 573 bp, Homo sapiens
  misc_feature: GZ8MTXP01AJZYW.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggagggggccaggggctcggtggtaacgttaggtgcttttgaatagtcgtggggccaagggacaagtggtcaccgtctctcagcctccaccaagggcccagtccggtccttcccccgtggccacccctcctcccaacgacgcctacctcgtcgggggccacgacgccggccctcggggcctgccgttgggtcaacgggtacctacttccgcgttgaactcgaactgggacgcggggcgttgggaaccg

SEQ ID NO: 378071 - DNA, 606 bp, Homo sapiens
  misc_feature: GZ8MTXP01AMBYM.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggagggggccaggggctcggtggtaacggttaggtgtcttttgaattagtcgtggggaccaaagggacaagtgggtcaccgtctcctcacgcctaccaccgaacgggcccagtccggtcccttcccccgtggcccacccctccgtaccaacgacgccaccgtcggtcgggggccacgacggccggccccgttggggccctcggcccgttgggtaccaaacgggtaccttaccgtttcccgacgttcgaacttcggaactggacggcgggcgttcgggaacg

SEQ ID NO: 378072 - DNA, 540 bp, Homo sapiens
  misc_feature: GZ8MTXP01D5SIO.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggagtgggagggatccctcccgatctttggcaaaccacacctacgcacacaagttccaggcagactcacgataccgcgacaatccacgagcacagtactacatggagatgagtagccgtgagatctgacgacacggccgtgtatttctgtgcgagaggagggggccgagggggcttcgggttgggttaacggttaagggtgtcgttttgagttagtcgttggggaaccg

SEQ ID NO: 378073 - DNA, 531 bp, Homo sapiens
  misc_feature: GZ8MTXP01A64XU.38.26.C04.1.454.CMB.2.raw
  modified_base (318)..(318): a, c, t, g, unknown or other
  modified_base (360)..(360): a, c, t, g, unknown or other
  modified_base (471)..(471): a, c, t, g, unknown or other
  modified_base (480)..(480): a, c, t, g, unknown or other
  modified_base (491)..(491): a, c, t, g, unknown or other
  modified_base (494)..(494): a, c, t, g, unknown or other
  modified_base (510)..(510): a, c, t, g, unknown or other
  modified_base (513)..(513): a, c, t, g, unknown or other
  modified_base (518)..(518): a, c, t, g, unknown or other
  modified_base (520)..(520): a, c, t, g, unknown or other
  modified_base (525)..(526): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggagggggccaggggctcggtggtaacgttaggngtcttttgaattatcgtggggaccaaaggggcaagtgggtcaccgtctcctcagcctcacgaacggcccatccggtcctcccctggccacccctctcaagcgccacctcgnggggcacgngccgcctggcngcnggtcagctacttcagnaangaacngngcggnnggaac

SEQ ID NO: 378074 - DNA, 574 bp, Homo sapiens
  misc_feature: GZ8MTXP01B39J7.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccaggggctcggtggtaacgttaggtgcttttgaatatcgtggggccaagggacaagtcggtcaccgtctcctcacgcctccaccaacgggcccatccggtcttcccctgccaccctcctcagacgccacctcgtgggggccacgacggccggcccgtcgggctcggccgttggtaccgaacgggtacctaccgttcccgacgttcgaatccggaactggaggcggggcgttggaaccgg

SEQ ID NO: 378075 - DNA, 542 bp, Homo sapiens
  misc_feature: GZ8MTXP01DGAO5.38.26.C04.1.454.CMB.2.raw
  modified_base (278)..(278): a, c, t, g, unknown or other
  modified_base (318)..(318): a, c, t, g, unknown or other
  modified_base (461)..(461): a, c, t, g, unknown or other
  modified_base (470)..(470): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaaatccacgagcacagtctacatgganatgagtagcctgagatctgacgacacggccgtgtatttcngtgcgagaggagggggccaggggctcggtggtaacgttaggtgtcttttgaatatcgtggggccaaagggacaaatggtcaccgtctctcagcctcaccaaggcccatcgtctcccctgcaccctctccaagacgcacctcgnggggcacgngcggcctgggctgcttggtcaaacggtacctacttccgcgttagaactcgaacgtgagcgggcgttggaacg

SEQ ID NO: 378076 - DNA, 582 bp, Homo sapiens
  misc_feature: GZ8MTXP01BORBE.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtgcgacacggccccctggacaaggggcttggagtggagtggggagggatccctcccgattctttggacaaaccacacctacgcacacaacgttacccaggaacagactcacgattaccgcggacatccacgagcacagtactacagtggagatgagtacgccgtagagatctacggacgacgaccggtccgtgttactttcgtggtgcggaggacgggacgggggccgaggggtcgacggttcggggttagggttaacggttagggtcgttcgttttaggacgttaagttcggtaacggggg

SEQ ID NO: 378077 - DNA, 604 bp, Homo sapiens
  misc_feature: GZ8MTXP01CZDGR.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaacggtcccctgcaaggcttcgtgggaggcaccttcagcacctatactttcagcgtgggtgcgacgacggcccctggacgaagggcttggaggtggagtgggaggatcccgtccgattcgtttggacaaaccacacctacgcacacaacgtcccaggaacagactcacgataccgcgaacgactccacgacgacacagtactacagtaggagagtgagtacgcgtaggacgagtactaggaaccgacgaccggtccgtagttagtttcgtggtcggcggaacggaggggtacgggggccgtaagggggtcgttaccggggttagggttaaccggtttgggttagtcgtttttaggagttacgtcggttcggggtaaccgg

SEQ ID NO: 378078 - DNA, 589 bp, Homo sapiens
  misc_feature: GZ8MTXP01A2IU8.38.26.C04.1.454.CMB.2.raw
  modified_base (351)..(351): a, c, t, g, unknown or other
  modified_base (426)..(426): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttcgtggaggcaccttcagcacctatactttcagctgggtgcgacaggcccctggacaagggcttgagtggatgggagggactcccgtccgattcgtttggactaaaccncacctacgcacacaagttcccaggcagactcacgtactaccgcgacaactccacgagcacagtactacatcgganatgagttagccgtgagtatcgtagaccgacgacggtaccgttgttacgtttcgtaggttcgaacggtaagacggggtaacgggggcccgaggggtcgttccgggttagggttaaccggtttaagggtgtcgtttttagacgttacgtcggttcggggaacccg

SEQ ID NO: 378079 - DNA, 582 bp, Homo sapiens
  misc_feature: GZ8MTXP01ALNLA.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccaggggctcggtggtaacgttaggtgtcttttgaatatcgtggggccaaagggacaagtgggtcaccgtctctcacgcctccacaacggcccatccggtccttccccgtggccaccctcctccaacgcgccacctcgtcgggggcaccgacggccggcccgtgggcctcggccgttgggtaccgaacgggtacctaaccgtttcccgacgttcgaactcgaacgtggcggccgggcgttcgggaacg

SEQ ID NO: 378080 - DNA, 573 bp, Homo sapiens
  misc_feature: GZ8MTXP01B757R.38.26.C04.1.454.CMB.2.raw
  modified_base (246)..(246): a, c, t, g, unknown or other
  modified_base (567)..(567): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgngacgaatccacgagcacagtctacatggagatgagtagcctgagatctagacgacacggccgtgtatttctgtgcgagaggagggggccaggggctcgggtagtaacgtaggtgtctttgaatagtcgtggggaccaaagggacaagtcggtacaccgtctctcacgcctaccacgaacggcccagtccggtccttccccgtggccacccctcctacaaacgcgccaaccgtcgcggggcacgacggccggccctggggctcgcccgttgggtacaacggtactacgttccgacgttcaatccgaacgtggaggcggtcgnggaacg

SEQ ID NO: 378081 - DNA, 574 bp, Homo sapiens
  misc_feature: GZ8MTXP01D7BMZ.38.26.C04.1.454.CMB.2.raw
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttcngtgcgagaggagggggccaggggctcggtcggtaacgttaggtgtcttttgaatatcgtggggccaaagggacaagtgggtcaccgtctcctcacgcctccaccgaacgggccctacgtccggtccttcccccgtggccacccctcctaccaagtacgccaccgtcgtcggggcacgcgccggcccgtgggctcgccgttgggtcaaggacctaacttccgcgttgaactcgaacgtggaggcgggtcgttggaacg

SEQ ID NO: 378082 - DNA, 573 bp, Homo sapiens
  misc_feature: GZ8MTXP01CC00S.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgatagcctgagatctgacgacacggccgtgtatttctgtgcgagaggagggggccagggggctcgggtggtaacgttaggtgtcttttgaatagtcgtggggaccaaaggggacaagtcgggtacaccgtctcctcagccctaccaaacgaacgggcccatccgggtccttcccccgtcggccacccctcctaccaacgacgccacctcgtcggggcacgcgccggccctgggctcgcttcggtcaaggactacttccgcgttgaactcgaacgtgacggcggcgttggaacg

SEQ ID NO: 378083 - DNA, 458 bp, Homo sapiens
  misc_feature: GZ8MTXP01DI1JE.38.26.C04.1.454.CMB.2.raw
  modified_base (191)..(191): a, c, t, g, unknown or other
  modified_base (449)..(458): a, c, t, g, unknown or other
tcagtcgatcacgtcacgaccggtgctcgatttagtctagcgactttgggtttgggatggttttctcgatgggggctgggagggctttgttggagaccttgcacttgtactccttgccattcagccagtcctggtgcaggacggtgaggacgctgaccacacggtacgtgctgttgtactgctcctcccgnggcttttgcttggcattatgcacctccacgccgtccacgtaccagttgaacttgacctcagggtcttcgtggctcacgtccacaccacgcatgtgacctcaggggtccggagatcatgaggtgtccttgggttttggggggaagaggaagactgacggtccccccaggagttcgaggtgctgggcacgaagcggccctgggctgcctggtcagggctacttcagtgatcgactgagcgggctggcaaggcgcagtagnnnnnnnnnn

SEQ ID NO: 378084 - DNA, 535 bp, Homo sapiens
  misc_feature: GZ8MTXP01AXTD1.38.26.C04.1.454.CMB.2.raw
  modified_base (345)..(345): a, c, t, g, unknown or other
  modified_base (414)..(414): a, c, t, g, unknown or other
  modified_base (436)..(436): a, c, t, g, unknown or other
  modified_base (466)..(466): a, c, t, g, unknown or other
  modified_base (508)..(508): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttggagtggatgggaggatccgtcccgatcttggcaaacncactacgcacacaagtcccaggcagactcacgataccgcgacactccacgagcacagtactacatgganatagagtagccgtagagatcgngacgacgcggccgtgtattctgtgcgaggngggacgggggccgaggggcgttcgggttggttaacggttggngtctttgattcgtcgttgggggaaccg

SEQ ID NO: 378085 - DNA, 618 bp, Homo sapiens
  misc_feature: GZ8MTXP01D79AE.38.26.C04.1.454.CMB.2.raw
  modified_base (448)..(448): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctcggtgaaggtcccctgcaaggcttcgtggaggcaccttcagcactatacttcagcgtgggtgcgacacggcccctggacaagggcttgaggtggagtggggagggtactcccgtcccgattcgttaggaccaaaccgacacctacgacacaactaacgttaccaagaacagacctacacgacgttaccgacggaacaactccacgagcaacagtactacatgganatgagtagccgtagatatacgtaggaaccgacgaccggtccgttagttactttcgtcgccggtaaggaggaggggacgggggcccgaagggggtccgttacgggttagggttaaccggtttaagggttcgttaacgttttggagtttacggtccggttcggggtaaccgg

SEQ ID NO: 378086 - DNA, 540 bp, Homo sapiens
  misc_feature: GZ8MTXP01BYHSR.38.26.C04.1.454.CMB.2.raw
  modified_base (387)..(387): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggaggatcctcccgatctttggcaaaccacacctacgcacacaagttcccaggcagactcacgattaccgngacgaatccacgagcacagtactacatggagatgagtagccgtgagatcgtgacgacacggccgtgtatttctggtgcggaggaggagggggccgagggggcttcgggttggttaacggttaaggtgtgttttgattagtcgttggggaaccg

SEQ ID NO: 378087 - DNA, 536 bp, Homo sapiens
  misc_feature: GZ8MTXP01DR8KC.38.26.C04.1.454.CMB.2.raw
  modified_base (315)..(315): a, c, t, g, unknown or other
  modified_base (509)..(509): a, c, t, g, unknown or other
  modified_base (515)..(515): a, c, t, g, unknown or other
tcagtcgatcacgtcacgaccggtgctcgatttagtctagcgactttgggtttgggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttcngtgcgagagagggggccagggggctcggtggtaacgttaggtgtcttttgaattatcgtggggccaaaggggacaagtggtcaccgtctctcagcctccaccaagggcccatcgtcttcccctgcaccctcctccaagacgcacctcgtggggcacacgcggccctgggctgccttggtcaaggactacttccncgttgntcgaactgagcggcgttggcg

SEQ ID NO: 378088 - DNA, 550 bp, Homo sapiens
  misc_feature: GZ8MTXP01D11X7.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccagggggctcggtggtaacgttaggtgcttttgaattatcgtggggccaaaggggacaagtgggtcaccgtctcctcagcctcaccaagggcccatccggtcttcccctggccaccctccgtccaagacgccacctcgtcgggggcacgacgcggccctgggctgccttggtcaggactacttccgacgttgaatcgaactgagcggcttggaacg

SEQ ID NO: 378089 - DNA, 557 bp, Homo sapiens
  misc_feature: GZ8MTXP01ER3T2.38.26.C04.1.454.CMB.2.raw
  modified_base (533)..(533): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccagggggctcggtggtaacgttaggtgcttttgaattagtcgtggggccaaagggacaagtggtcaccgtctctcagcctccaccaacgggcccatccggtccttccccgtcggccaccccgtcctccaacgacgcacctcgtcgggggcacgacgcggcccgtgggctcgccgttggtcaaggctacttccgcgttgntcgaactgagcggtcgttggaacg

SEQ ID NO: 378090 - DNA, 531 bp, Homo sapiens
  misc_feature: GZ8MTXP01EH1BU.38.26.C04.1.454.CMB.2.raw
  modified_base (247)..(247): a, c, t, g, unknown or other
  modified_base (485)..(485): a, c, t, g, unknown or other
  modified_base (490)..(490): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (530)..(530): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgngacgaaatccacgagcacagtctacatggagatgagtagcctgagatctgacgacacggccgtgtatttctgtgcgagaggagggggccagggggctcggtggtaacgttaggtgtcttttgaatatcgtggggaccaagggacaagtggtcaccgtctctcacgcctcacaacggccatcgtcctccctgcaccctcgtacaagacgcacctcgcggggcacgacgcggcctgggcncgccnggtcaggctacttcgagttnaatcgaactggngcgcgngng

SEQ ID NO: 378091 - DNA, 523 bp, Homo sapiens
  misc_feature: GZ8MTXP01DM1KQ.38.26.C04.1.454.CMB.2.raw
  modified_base (317)..(317): a, c, t, g, unknown or other
  modified_base (433)..(433): a, c, t, g, unknown or other
  modified_base (456)..(456): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttcngtgcgagagagggggccaggggctcggtggtaacgttagtgcttttgaatatctggggccaaaggggcaatggtcacgtctctcagcctcacaaggccatcgtctcccctgcaccnctcaagcgcactctggggcacgngcgccctggctgccgttggtcaaggactacttccgacgttgaatcgaactggagcgggtcgttggcg

SEQ ID NO: 378092 - DNA, 576 bp, Homo sapiens
  misc_feature: GZ8MTXP01CBSEG.38.26.C04.1.454.CMB.2.raw
  modified_base (247)..(247): a, c, t, g, unknown or other
  modified_base (295)..(295): a, c, t, g, unknown or other
  modified_base (317)..(317): a, c, t, g, unknown or other
  modified_base (516)..(516): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgngacgaatccacgagcacagtctacatggagatgagtagcctgagatcngacgacacggccgtgtatttcngtgcgagaggagggggccagggggctcgggtggtaacggttggtgtcttttgaattagtcgtggggacccaaaggggacaagtcgggtcaccgtctcctcacgccctccaccgaacgggcccagtccgtccttcccctggcccaccctcctccaacgacgcaccgtcgtcggggcacgacgccggcctcgggctcgccnggtcaacggtacctacgttccgacgttgaacttcgaacgtgacggttcggcgttggaacg

SEQ ID NO: 378093 - DNA, 537 bp, Homo sapiens
  misc_feature: GZ8MTXP01EKBUY.38.26.C04.1.454.CMB.2.raw
  modified_base (525)..(525): a, c, t, g, unknown or other
tcagtcgatcacgtcacgaccggtgctcgatttagtctagcgactttgggtttgggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccagggggctcggtggtaacgttaggtgtcttttgaatatcgtggggccaaaggggacaatgggtcaccgtctcctcagcctcaccaagggccatcggtcttcccctgcaccctctccaagcgcacctcgtggggcacgacgccggccctgggctcgccttggtcaaaggctacttcgacgttgaatcgctgngcgggcttggcg

SEQ ID NO: 378094 - DNA, 559 bp, Homo sapiens
  misc_feature: GZ8MTXP01EBDI5.38.26.C04.1.454.CMB.2.raw
  modified_base (448)..(448): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgtcttttgaatagtcgtgggccaagggacaatggtcacgtctcctcacgcctccaccaacgggcccatccggtccttccccgtcggccnccctcctccaagtcgccacctcgcgggggcacgacgccggcctcgggctgccttggtcaacggacttcgttccgacgttgaactcgaacgtggacgcgggcgttggaaccg

SEQ ID NO: 378095 - DNA, 556 bp, Homo sapiens
  misc_feature: GZ8MTXP01C4K3K.38.26.C04.1.454.CMB.2.raw
  modified_base (474)..(474): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagctgggtgcgacaggcccctggacaagggcttgagtggagtgggaggatccgtcccgatcgttggacaaaccacacctacgcacacaagttaccagaacagactacacgataccgcgaacgaactaccacgagcacagtactacataggagatgagtagccgtagagatcgtagacgacgacggtaccgtgtatttcngtgcggaaggaggaggggccgaggggcgttacgggttggttaacggtttggtgtcgttttagagttagtcgttggggaaccg

SEQ ID NO: 378096 - DNA, 513 bp, Homo sapiens
  misc_feature: GZ8MTXP01DM7IL.38.26.C04.1.454.CMB.2.raw
  modified_base (459)..(459): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagtcagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgcatttctgtgcgagagagggggccagggggctccggtggtaacgttaggtgtcttttagatgtctggggaaccaaggggacaatgggtcacgtctcctcagcctcacaggccatcgctccctgcacctctcagagcactctggggcacncgcgcctgggctgcctggcaaggcttacttcacgtgatcgactgagcggcgtgg

SEQ ID NO: 378097 - DNA, 592 bp, Homo sapiens
  misc_feature: GZ8MTXP01D41JL.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcggtgaacggtcccctgcaaggcttcgtgggaggcaccttcagcacctatactttcagtcgtgggtcgcgacgacggccccctggacaagggcttgagtggagtggggagggactcccgtccgattcgtttaggacaaaccacacctacgcacactacgtacccagcagactcacgactaccgcggacatccgaacgagacacgagtactacagtggagatgagtacgccgtagagtactacgtacgaccgacgacggaccgttgttacgtttctggtcggaacggaggaggggtacgggggccgagggggtcgttacggggttggttaacggttgggtgtcgttttgcgttacgtcgttggggaaccg

SEQ ID NO: 378098 - DNA, 607 bp, Homo sapiens
  misc_feature: GZ8MTXP01AW3T8.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccagggggctcggtggtaacgttggtgtcttttgaatagtcgtggggacccaaaggggacaagtggtcaccgtctcctcacgccctccaccaacgggcccactcggtccttccccctcggccaccccgtcctccaacgacgccacctcgtcgggggccacgacggcccgggccccgtcggggccgtcggcccgttcgggttaccgaaacgggaccttaaccgtttcccgacggttcgaacgtcgaacgtggacggccgggcgttgggaaccgg

SEQ ID NO: 378099 - DNA, 579 bp, Homo sapiens
  misc_feature: GZ8MTXP01EL214.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccagggggctcggtggtaacgttaggtgtcttttgaatagtcgtggggaccaagggacaagtggtcaccgtctcctcacgcctccaccgaacgggcccactccggtccttcccccgtcggccaccccgtcctaccaacgacgccgaccgtcgtcgggggcacgacgccggcccgtcgggctcgccttcggtacgaacgggtactacttccgcgttgaactcgaacgtgaggcggcgttgggaacg

SEQ ID NO: 378100 - DNA, 666 bp, Homo sapiens
  misc_feature: GZ8MTXP01CBHJ4.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccagagcacagtctacatggagatgagtagcctgagatctgacgacacggccgtgtatttctgtgcgagaggagggggccagggggtctcgggtggtaacggttaggtgtcttttgaattacgtcggtgggggaccctaaaggggaccaaagttcgggtacctacccggtcctcccgtcacggccctacccgacccgaaacgggcccctacgttccgggttccccttcccccgtcggccctaccccttcccgtacccgaaacggaccgcccgtaaccgtccggtcgggggaccaccgacggccggtcccgtcgggccgtcggcccgttgggtaccgaaacgggtaccttaccgttcccgttacgttcggaactcggaacgtcgggacggttccggggcgttcgggaaccgg

SEQ ID NO: 378101 - DNA, 584 bp, Homo sapiens
  misc_feature: GZ8MTXP01CHE4C.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggcctgtatttctgtgcgagaggagggggccaggggctcggtcggtaacgttaggtgtcttttgaattatcgtggggccaaaggggacaagtggtcaccgtctcctcacgcctccaccgacggccctatccggtcctcccctcggccacccctcctcccaagacgaccaccgtcgtcgggggcacgacgccggcccgtgggcctcgccgttgggtaccaaacgggtaccttacttcccgacgttcgaacgtcgaacgtggacggcgggtcgttgggaaccg

SEQ ID NO: 378102 - DNA, 625 bp, Homo sapiens
  misc_feature: GZ8MTXP01BWLCU.38.26.C04.1.454.CMB.2.raw
  modified_base (278)..(278): a, c, t, g, unknown or other
  modified_base (321)..(321): a, c, t, g, unknown or other
tcagtcgatcacgtcacgaccggtgctcgatttagtctagcgactttgggtttggggatggttttctcgatgggggctgggagggctttgttggagaccttgtacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacacggccgtgtactttccgngcgaggaggagggggccagggggctcgggtggtaacgttaggtgtcgttttgatagtcgtaggggccaaaggggacaaagtcgggtaccacccggtctaccctcgacgccctacccgaccgaaacgggccctaacgtccgggttcccttcccccgtcggcccaccccgtcctacccgaacgggacgcccgaacccgtcggtcgggggaccaccgacggccggcccgtgggcctcgccgtcggtcaaacggtaccttacgtccgaacgttgacttcgaacgtgaagcgggcgttcggcgaaggcg

SEQ ID NO: 378103 - DNA, 630 bp, Homo sapiens
  misc_feature: GZ8MTXP01CP349.38.26.C04.1.454.CMB.2.raw
  modified_base (276)..(276): a, c, t, g, unknown or other
  modified_base (293)..(293): a, c, t, g, unknown or other
  modified_base (315)..(315): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagtccaggacagactcacgattaccgcgacgaatccacgagcacagtctacatgganatgagtagctgagatcngacgacacggccgtgtatttcngtgcgaggaggagggggccaggggctcggtaggtaacggttaggtgtcttttagaattagtcgtaggggaccaaaggggacaagtcgggtaccaccgtctcctcacgccctaccaaccgaacggcccctacgtcccggttcccttcccccgtcggccctaccccttcccgtacccgaaacgacgccgtacccgtcgtcgggggccaaccgacggccggcccgtcgggcctcggtccgttcgggtaccgaaacggtacccttacgttcccgacgttacgaactccggaacgtggacgggcgggtcgttgggaaccg

SEQ ID NO: 378104 - DNA, 598 bp, Homo sapiens
  misc_feature: GZ8MTXP01AWZT4.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccaggggcgtcggtggtaacgttaggtgtcttttgaatagtcgtggggaccaaagggacaagtggtcaccgtctcctcacgcctccgaccacgggcccagtccggtccttccccgtcgccacccctccgtccaacgacgccaccgtccgtcgggggccacgacggccggcccgtcggggcctcggccgttgggtaccgaacgggtaccttaccttccgacgttcggaacttcgaaccgtggacggccgggtcgttcgggaacgg

SEQ ID NO: 378105 - DNA, 548 bp, Homo sapiens
  misc_feature: GZ8MTXP01D5EQF.38.26.C04.1.454.CMB.2.raw
  modified_base (463)..(463): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaggcttctggagcaccttcagcacctatactttcagctgggtgcgacacggccccctggacaagggcttggagtggagtggggagggatcccgtcccgatctttggacaaaccacacctacgcacacacgttccaggcagactcacgatacgcgacactcacgacgcacagtactacataggagatgagtagcgtagagatcgtgacgacgacggcgtgtatttcgngtgcgaggagggcgggggccgagggggcgttcgggttggttaacggttgggtagtcgttttgagttagtcggttggggtaaccgg

SEQ ID NO: 378106 - DNA, 559 bp, Homo sapiens
  misc_feature: GZ8MTXP01CYWBM.38.26.C04.1.454.CMB.2.raw
  modified_base (347)..(347): a, c, t, g, unknown or other
  modified_base (414)..(414): a, c, t, g, unknown or other
  modified_base (461)..(461): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagctgggtcctggtgaaggtcccctgcaaggcttctggaggcaccttcagcacctatactttcagctgggtgcgacaggccccctggacaagggcttgagtggagtgggagggatcccgtccgatctttggacaaacncacctacgcacacaagtccagcagactcacgataccgcgacgaatccacgagcacagtcacatgganatgagtagccgtagagtaatctagacgacgacggccgtgttattcgngtgaacggtagacgggtagggggccgaaggggtcgttacgggttgggttaaacggttgggtcgttcgttttgagttacgtccggttggggtaacccgg

SEQ ID NO: 378107 - DNA, 596 bp, Homo sapiens
  misc_feature: GZ8MTXP01EJK5N.38.26.C04.1.454.CMB.2.raw
  modified_base (351)..(351): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacaggcccctggacaagggcttgagtggagtggggaggatcccgtccgtatcgtttcggacaaaccncacctacgcacacaagttcccaaggcagactacacgacttaccgacggacgaactccacgacgacacacgtactacataggagatagaagtacgccgtagagatcgtagaccgacgacgggccgttggttactttcgtggtcggcggagggacgggacgggggcccgaagggggtccgttacgggggttggttaaccgggtttaagggtcggttcttttaggattacgtcggttgggggtaacgg

SEQ ID NO: 378108 - DNA, 584 bp, Homo sapiens
  misc_feature: GZ8MTXP01B0A8S.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttctggagcaccttcagcacctatactttcagctgggtgcgacacggcccctggacgaagggcttggagtggagtggggagggactcccgtcccgattcgtttggaccaaaccacaccctacgcacacaagttaccagcagactcacgacttaccgcggacaactccaacgacgacacagtacctacagtacggagatagagtacgccgtgagatcgtagacgacgaccggtccgtgttatttcgtgtgcggtaggagggacgggggcgagggggcgttcggggttgggttaacgggtttgggtggttcgtttggtacgttagtcggttgggggtaaccg

SEQ ID NO: 378109 - DNA, 554 bp, Homo sapiens
  misc_feature: GZ8MTXP01BQYX3.38.26.C04.1.454.CMB.2.raw
  modified_base (426)..(426): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttctggagcaccttcagcacctatactttcagctgggtgcgacacggcccctggacaagggcttggagtggagtggggaggatcccgtccgattcgttggacaaaccacacctacgacacacaacgtccagcagactcacgacttaccggcgaacaactccacgacgacacagtactacatgganagtgagtacgacgtagagatcgtagacgacgacggtccgtgtatttcgtgtgcgaggagggacggggccgaggggcgttcgggttggttacggttaaggtgtgttttgagttagtcggttgggaaccg

SEQ ID NO: 378110 - DNA, 546 bp, Homo sapiens
  misc_feature: GZ8MTXP01EZB4W.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggagtgggagggatccctccgatctttggcaaaccacacctacgcacacaagttaccagggcagactcacgattaccggcgacgaatccacgagcacagtactacatggagatgagtagccgtgagatctgacgacgacggccgtgtatttctgtgcggagagggagggggccgagggggcgttcgggttgggttaacggttaagggtgtcgttttgattagtcgttggggaacg

SEQ ID NO: 378111 - DNA, 606 bp, Homo sapiens
  misc_feature: GZ8MTXP01ANM5V.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccaggggctcggtggtaacgttaggtgtcttttgaattagtcgtggggaccaaagggacaagtcggtcaccgtctcctcacgcctaccaccgaacgggcccacgtccggtcccttcccccgtcggccctaccccgtcctacccaacgcgaccgacccgtcgtcgggggccaccgacgcccggcccgtcgggcctcgcccgttggtaccaacgggtaccttaccgttccgcgttcgaacgttcgaaccgtggacggcgggtcgttcggaaccg

SEQ ID NO: 378112 - DNA, 540 bp, Homo sapiens
  misc_feature: GZ8MTXP01BMDF0.38.26.C04.1.454.CMB.2.raw
  modified_base (348)..(348): a, c, t, g, unknown or other
  modified_base (473)..(473): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggccccctggacaagggcttgagtggatgggagggatccctccgatctttggacaaaccncacctacgcacacaagttcccaggaacagactcacgattaccgcgacatccacgagcacagtctacatggagatgagtagccgtgagatcgtgacgacgacggccgtgtatttctggtgcgaggnggagggggccgagggggcttcgggttggttaacgttggtgtcgttttgattagtcgttggggaaccg

SEQ ID NO: 378113 - DNA, 548 bp, Homo sapiens
  misc_feature: GZ8MTXP01B5AMZ.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatcccgtccgatctttggacaaaccacacctacgcacacaagtccagcagactcacgataccgcgacgaatccacgagcacagtactacagtggagatgaagtagcgtagagatcgtagacgacgacggccgtgtatttctgtgcgaggaggacggggccgaggggcgttcgggttgggttaacggttaagggtgtcgttttgagttacgtcggttggggaaccgg

SEQ ID NO: 378114 - DNA, 588 bp, Homo sapiens
  misc_feature: GZ8MTXP01EYUOR.38.26.C04.1.454.CMB.2.raw
  modified_base (316)..(316): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggcgtgtatttcngtgcgagaggagggggccaggggctcggtggtaacggttaggtgtctttgaatagtcgtggggaccaaaggggacaagtcggtcacccgtctcctcacgcctaccacgaacgggcctactccggtacccttcccctggccacccctccgtaccgaagtcgaccaccgtcgcggggccacgacgccggtcccgtcgggctcggccgttggtacgaaacggtaccttacttccgacgttcgaacgtcgaacgtggacggcgggcgttcggaacg

SEQ ID NO: 378115 - DNA, 597 bp, Homo sapiens
  misc_feature: GZ8MTXP01CBANN.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctcggtgaaggtcccctgcaaggcttctggaggcaccttcagcacctatactttcagctgggtgcgacacggcccctggaccaagggcttggaggtggagtggggagggactcccgtcccggattcgtttggaccaaaccacaccctacgcacacaagtcccaggcagactcacgataccgcggacgaactccgacgagacacagtctaacagtaggagatagagtagccgtgagtactacgtagaaccgacgacggtccgttgttactttcgtggtggcggtaggacgggacgggggccgagggggtcgttacggggttagggttaaccgggtttaagggtcggttcgttttggagttacgtcggttcgggggaaccgg

SEQ ID NO: 378116 - DNA, 583 bp, Homo sapiens
  misc_feature: GZ8MTXP01ASUPA.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagcctgggtcctcggtgaaggtcccctgcaaggcttctggaggcaccttcagcacctatactttcagcgtgggtgcgacgacggcccctggacaagggcttggagtggagtggggaggactcccgtcccgattcgttggacaaaccacacctacgctacacaacgttccaggaacagacctacacgacttacccgcgaacgaactaccacgacgacacagtactacagtggagatagagtacgccgtagagatcgtagaccgacgacggtccgtgttacttcgtggtggaacggaggacgggacgggggccgaggggtcgttcgggttggttaacggttaagggtgtcgttttgagttacgtcggttgggaaccgg

SEQ ID NO: 378117 - DNA, 551 bp, Homo sapiens
  misc_feature: GZ8MTXP01C69IY.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatcccgtccgattctttggcaaaccacacctacgcacacaagttcccaggcagactcacgattaccgcggacgaatccacgagcacagtactacataggagatgagtagccgtagagatcgtgaccgacacgggccgtgtatttcgtgtggcgaggagggagggggccgagggggcttcggggttggttaacggttgggtgtcgttttggattagtcgttggggaaccg

SEQ ID NO: 378118 - DNA, 556 bp, Homo sapiens
  misc_feature: GZ8MTXP01ERTWK.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagctgggtgcgacaggccccctggacaagggcttgagtggatgggagggatcccgtcccgatctttggacaaaccacacctacgcacacaagttaccaggcagactcacgattaccgcgacgaatccacgagacacagtactacatggagatgagtagccgtgagatctgacgacgacggccgtgttagtttcgtgtgcggaggagggacgggggccgagggggtcttcggggttggttaacggttaagggtgtcgtttggagttagtcgttggggaaccg

SEQ ID NO: 378119 - DNA, 671 bp, Homo sapiens
  misc_feature: GZ8MTXP01D2E1V.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctcggtgaacggtcccctgcaggcttcgtggagcaccttcagcactatacttcagcgtggtgcgacgacggcccctggacgaaggtctggaggtggagtggggacgggtactcccgtccgtattcgttacggacaaaccacaccctacgacaacaactaacgttaccgaaggaacagacctaccgaacgacgttaccggacggaacaactacccgaacgacgccaactaacgtacctaacgaagtagggaagtagtaggaagtacgtccggtaggtaagtataccgtaggacccgacggaccggtaccgttgttagtttcgtggtcggaacggtagggacggggacggggccgggtagggggtccgttacgggggttacgggttaaacgggtttgggttcggtttaacgtttttaggacgtttacggttccgggttaacgggggtaaccgg

SEQ ID NO: 378120 - DNA, 636 bp, Homo sapiens
  misc_feature: GZ8MTXP01A9BRI.38.26.C04.1.454.CMB.2.raw
  modified_base (297)..(297): a, c, t, g, unknown or other
  modified_base (319)..(319): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacagtggagatgagtagcctgagatcngacgacacggccgtgtatttcngtgcgagaggagggggccaggggctcgggtaggtaacgttaggtgtcttttagaattagtcgtaggggaccaaagggacaagtcgggactaccgtctcctcacgccctaccgaccgaacgggccctagttccggtcccttcccccgtggccctacccctaccgtaccgaaagaccgccgtaccgtccggtcgggggaccacgacggcccgggtcccgtggggccttcgggcccttggggtaccaaacgggtaccctacgttacccgaggttcgtaacttccgaacgtcgggacggccggggaacgttcgggaaccgg

SEQ ID NO: 378121 - DNA, 630 bp, Homo sapiens
  misc_feature: GZ8MTXP01D8J9Z.38.26.C04.1.454.CMB.2.raw
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttcngtgcgagaggagggggccagggggctcgggtaggtaacggttaggtgtcttttggaatagtcgtggggccaaagggacaagtggtcaccgtctcctcacgcctccaccaacgggcccacgttccggtccttcccccgtcggcctacccctcccgtaccaaacgacgccgtacccgtccgtcgggggccaaccgacggcccggtcccgtcgggggcctcggcccgttcgggtaccgaaacgggtaccttaaccgttcccgacggttacgaacgttaccgaaccgttggacgggccggggtcgttcggggaaccg

SEQ ID NO: 378122 - DNA, 611 bp, Homo sapiens
  misc_feature: GZ8MTXP01ATZ17.38.26.C04.1.454.CMB.2.raw
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagctgagatctgacgacacggccgtgtatttcngtgcgagagagggggccaggggctggtggtacgttaggtgtctttgaatatcgtggggaccaaagggacaagtggtcaccgtctcctcacgcctaccaccgaacgggcccctagtcccggtccttcccccgtggccctaccccgtcctacccgaaacggtacgccacccgtcgtcgggggccacgacggcccgggtcccgtcggggcctcggcccgttgggtaccaaagggtacctaaccgttcccgacggttcgaacttccggaacgtcggacgggccgggcgttcgggaacg

SEQ ID NO: 378123 - DNA, 562 bp, Homo sapiens
  misc_feature: GZ8MTXP01DU5PA.38.26.C04.1.454.CMB.2.raw
  modified_base (441)..(441): a, c, t, g, unknown or other
tcagtcgatcacgtcacgaccggtgctcgatttagtctagcgactttgggtttggggatggttttctcgatgggggctgggagggctttgttggagaccttgcacttgtactccttgccacttcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggcgtgtatttctgtgcgagaggagggggcaggggctcggtggtacgttaggtgtcttttgaatatcgtggggccaagggcaagtggtcacgtctctcagcctccacaacgggccagtccgtccttcccctggccnccctccgtcaagcgcaccgtcgtcggggcacgcgccggccgtcgggctcgccgttggtccgaacggtactaacttccgacgttcgaactccgaacgtcggacggcgggtcgttcgggaacg

SEQ ID NO: 378124 - DNA, 552 bp, Homo sapiens
  misc_feature: GZ8MTXP01EKSFX.38.26.C04.1.454.CMB.2.raw
  modified_base (423)..(423): a, c, t, g, unknown or other
  modified_base (425)..(425): a, c, t, g, unknown or other
  modified_base (468)..(468): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatccctcccgatcgtttggacaaaccgacaccctacgcacacagttccaggcagactcacgattaccgacgacaatccacgacgcacagtactacatgganangagtagcgtgagatctagaccgacgacggccgttgtagtttcnggtgcgaggaggacgggggcgagggggtcttcggggttggttaacggttaagggtgttcgtttgacttagtcgttggggaaccg

SEQ ID NO: 378125 - DNA, 578 bp, Homo sapiens
  misc_feature: GZ8MTXP01DV88L.38.26.C04.1.454.CMB.2.raw
  modified_base (417)..(417): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttctggagcaccttcagcactatactttcagctgggtgcgacacggcccctggacaagggcttgagtggagtgggaggatcccgtcccgattctttggacaaaccgacacctacgcacacaacgttccagcagactcacgataccgcgacatccacgagcacagtactacatgganagtgaagtagccgtagaagtatacgtagaccgacgaccgtaccgttgttatttcgtggtgcggaaggaggggacgggggccgaagggggtccgttacggggttcggttaacggtttaagggtgttcgtttttaggagttacgtccggttggggtaacccgg

SEQ ID NO: 378126 - DNA, 591 bp, Homo sapiens
  misc_feature: GZ8MTXP01CAOB0.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagctgggtgcgacacggcccctggacgaagggcttggagtggagtgggagggatcccgtccgatcgtttggacaaaccacacctacgcacacagttccagcagactcacgataccgcgacgactcacgagcacagtactacatggagatagagtacgccgtgagatacgtagaccgacgacggtccgttagttactttcgtggtggcggtaagggacgggacgggggttcccgaagggggtcgttacgggggttcgggttaacgggtttaagggtcgttcgttttggagtttacgtccgggttgggggtaacccgg

SEQ ID NO: 378127 - DNA, 578 bp, Homo sapiens
  misc_feature: GZ8MTXP01DTFVM.38.26.C04.1.454.CMB.2.raw
  modified_base (426)..(426): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttcgtggagcaccttcagcacctatactttcagctgggtgcgacacggcccctggacaagggcttgagtggagtgggaggatccctccgatctttggacaaacacacctacgcacacaagttaccaggaacagactcacgacttaccgacgacgactccacgacgcaacagtactacagtagganatagagtacgaccgtgagatacgtagaccgacgacggtccgtgttactttcgtgcggcgagggagggcgggggccgagggggtcgttacggggttcggttaacgggttgggttagttcgttttaggacgttacgtcggttcggggtaaccgg

SEQ ID NO: 378128 - DNA, 666 bp, Homo sapiens
  misc_feature: GZ8MTXP01CSN4E.38.26.C04.1.454.CMB.2.raw
  modified_base (277)..(277): a, c, t, g, unknown or other
  modified_base (319)..(319): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatgganatgagtagcctgagatctagacgacgacggccgtgtatttcngtgcgaggaggagggggccaggggctcgggtcggtaacggttaggtgtcttttgaattagtcggtggggaccaaaggggctaaagtcgggtacacccgtctcctcgacgccctaccgaacccgaacgggccctacgtccggttcccttcccccgtcggtaccctaccccgttcccgtacccgaaacggaccgtccgtacccgtcggtcgggggaccaaccggaccggtccgggcccgttgggacgtccggcccggttcgggtaccgaaacggtaacccgttaccgttacccgttacggttacgtaacgtaccgtaacgtgggacggccggggtcgttcgggaaccgg

SEQ ID NO: 378129 - DNA, 744 bp, Homo sapiens
  misc_feature: GZ8MTXP01C2HSF.38.26.C04.1.454.CMB.2.raw
  modified_base (337)..(337): a, c, t, g, unknown or other
  modified_base (587)..(587): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggacaaaccacactacgcacacaacgttcaggacagactcacgacttaccgcggaacgaatccacgagcacagtctacagtggagatgagtagcctagatactcgtagaaccgacgtacggtccgttagtttactttcgnggtcggacggaggaggggacgggggccctagggggcttcggggttacggggttaaacggtttaggttgttaccgttttaggaaactttaacggttcggggtacgggggaacccggtaaaaggggtaaccgtaaagggttcggtaccgtaaccccggtttctacccgacgtaccgaccctaccgaaacgggaccgtacctacgtcccgttccctaccccgtgacccctacccgtacgtaacgacggtaccncccgtacggttccggggcggaccaaccgggtcggtccccggtcggtcggtaccgtccggtacgttaccggtaaacgttaaccggttacccttcgttaccgttacggttacgtaaccggtacgtcggtaacgggcgggttacgccgggaagaaccggg

SEQ ID NO: 378130 - DNA, 541 bp, Homo sapiens
  misc_feature: GZ8MTXP01B8YBB.38.26.C04.1.454.CMB.2.raw
  modified_base (471)..(471): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggaggatccctccgatctttggcaaaccacacctacgcacacagtcccaggcagactcacgattaccgcgacgaatccacgacgcacagtctacatggagatgagtagccgtgagatctgacgacgacggccgtgtatttcgtgtgcgaggaggngggggccgagggggcttcggggttggttaacggttaaggtgtcgttttgagttagtcgttggggtaaccg

SEQ ID NO: 378131 - DNA, 571 bp, Homo sapiens
  misc_feature: GZ8MTXP01CQZJL.38.26.C04.1.454.CMB.2.raw
  modified_base (346)..(346): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaaagggcttgagtggatgggaggatccctccgatcttggacaaaccncacctacgcacacaagttcccaaggcagactacacgacttacccggcggacgaatccacgagcacagtctacagtggagagtgaagtacgaccgtgaagtactcgtacgacgacgacggtccgtgttatttcgcgtgcggtaaggagggagggggttccgagggggtcttcggggttaggttaacggttaaggtcgtcgttttgagttagtcggttggggaaccg

SEQ ID NO: 378132 - DNA, 577 bp, Homo sapiens
  misc_feature: GZ8MTXP01C2ZAM.38.26.C04.1.454.CMB.2.raw
  modified_base (296)..(296): a, c, t, g, unknown or other
  modified_base (571)..(571): a, c, t, g, unknown or other
tcagtcgatcacgtcacgaccggtgctcgatttagtctagcgactttgggtttggagatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatcngacgacacggccgtgtatttctgtgcgagaggaggggccaggggctcggtggtaacgttggtgtcttttagattgtcgtggggaccaagggacaagtggtcaccgtctcctcacgcctccaaccgaacgggcccactccggtccttcccccgtgcccctacccgtcccctccgaacgacgccacccgtcgtcgggggaccaacgcgccggccctggggctcgccgtggttcgaaacggtccttaccgttccacgtgatccgactggacgccgggngtcggg

SEQ ID NO: 378133 - DNA, 627 bp, Homo sapiens
  misc_feature: GZ8MTXP01A448F.38.26.C04.1.454.CMB.2.raw
  modified_base (358)..(358): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacacggcccctggacaagggcttggagtgggagtggggagggatcccgtccgattcgtttcggacaaaccncacctacgacacacaagttacccagggcagactcaacgtacttaccgcggaacaactacccgacggaacgcaacacgtaccacgagtaggagataggagttacggcctaggaagtatcgtagaaccgacgaccgggtccgttgttagtttccgtggttcggaacggaagggacggggacgggggcccgtagggggtccgttcggggttgggttaaaccgggttttgggcgtttcgtttaggagttacggttcggttcgggggaacccgg

SEQ ID NO: 378134 - DNA, 609 bp, Homo sapiens
  misc_feature: GZ8MTXP01CKJDH.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatcccacgagcacagtctacatggagatgagtagcctgagatctgacgacacggccgtgtatttctgtgcgagaggagggggccagggggctcggtggtaacgttaggtgtcttttgaattatcgtggggccaaggggcaagtggtcaccgtctcctcacgcctccaccgaacgggcccagtccggtccttccccctcggccaccccgtcctcccaacgacgccacccgtccgtcgggggccaccgacggccggcccgtcggggcctcggccgttcgggtaccgaaacgggtaccttaccgttcccgcggttcgaactccggtaaccgtggacggccggggtcgttcgggaaccgg

SEQ ID NO: 378135 - DNA, 533 bp, Homo sapiens
  misc_feature: GZ8MTXP01DGHCL.38.26.C04.1.454.CMB.2.raw
  modified_base (460)..(460): a, c, t, g, unknown or other
  modified_base (468)..(468): a, c, t, g, unknown or other
tcagtcgatcacgtcacgaccggtgctcgatttagtctagcgactttgggtttgggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggaggatcctccgatctttggcaaaccacacctacgcacacagttcccaaggcagactcacgattaccgcggacgaatccacgagcacagtctacatggagatgagtagccgtagagatctgacgcacggtccgtgtatttcngtgcgagnggagggggccgaggggcttcgggttggttacgttaaggtgtcttttgattagtcgttgggaaccg

SEQ ID NO: 378136 - DNA, 584 bp, Homo sapiens
  misc_feature: GZ8MTXP01D0CP1.38.26.C04.1.454.CMB.2.raw
  modified_base (479)..(479): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatacttcagcgtgggtgcgacgacggcccctggacaaggcttgagtggagtgggaggatcccgtccgattcgttggacaaaccgacaccctacgacacacaagttcccaaggcagactcacgactaccgcgacatccagagcacagtactacataggagagtagaagtagccgtagagaatctagaaccgacacggtccgtgttactttcgnggtgaacggaggacgggacgggggccgaagggggtcgttcggggttcggggttaaacggttggggtgttcgttttaggagttacggtcggttcgggggaacccgg

SEQ ID NO: 378137 - DNA, 543 bp, Homo sapiens
  misc_feature: GZ8MTXP01CD2NQ.38.26.C04.1.454.CMB.2.raw
  modified_base (206)..(206): a, c, t, g, unknown or other
  modified_base (295)..(295): a, c, t, g, unknown or other
  modified_base (317)..(317): a, c, t, g, unknown or other
  modified_base (450)..(450): a, c, t, g, unknown or other
  modified_base (470)..(470): a, c, t, g, unknown or other
  modified_base (487)..(487): a, c, t, g, unknown or other
  modified_base (521)..(521): a, c, t, g, unknown or other
  modified_base (530)..(530): a, c, t, g, unknown or other
  modified_base (538)..(538): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccncactacgcacacaagttccaggacagactcacgattaccgcgacgaatccacgagcacagtctacatggagatgagtagcctgagatcngacgacacggccgtgtatttcngtgcgagaggagggggccaggggctggtacggtaacgttggtgtctttgaatagtcgtggggaccaaaggggacaagtcggtacaccgtctcctcacgcctccacgaacggccctacgtccggtccttccccncgcctacccctctccaagcncaccgtcgcgggcacgngccggccgtggctcgcttggacagctcttcgcgngctagctgngcggtcgngaacg

SEQ ID NO: 378138 - DNA, 584 bp, Homo sapiens
  misc_feature: GZ8MTXP01A8RAW.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggcgtgtattctgtgcgagagagggggccaggggctcggtggtaacgttaggtgtcttttgaatagtcgtggggaccaaaggggacaagtggtcaccgtctcctcacgcctccaccgaacgggcccagtccggtccttccccctggccacccctcctaccaacgacgccaccgtcgtcgggggcacgacgccgggcccgtggggcctcgcccgttgggtaccgaaagggacctaaccttccgacgttcgaatcgaacgtggacggcgggcgttcgggaacg

SEQ ID NO: 378139 - DNA, 551 bp, Homo sapiens
  misc_feature: GZ8MTXP01A6T96.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaaatccacgagcacagtctacatggagatgagtagcctgagatctgacgacacggccgtgtatttctgtgcgagagagggggccaggggctcggtggtaacgttaggtgcttttgaatatcgtggggccaaaggggacaagtggtcaccgtctcctcagcctccaccaacgggcccatcggtcttccccctggccacccgtccttcaacgacgtccacctcgtcgggggcacgacgccggccctgggctgccttggtcaaggctacttccgcgttgaatcgaactgagcgggcttggcg

SEQ ID NO: 378140 - DNA, 641 bp, Homo sapiens
  misc_feature: GZ8MTXP01A9O3I.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctcggtgaacggtcccctgcagcttgtggagcacttcagcactatacttcagtcgtggtgcgacgcggccccgtggacgaggtctggaggtggagtggggaggtctcccgtccgtatcgttgacaaaccacacctacgacacacacgtaccagcagactacgacgtacgtaccgacgtaacgactaccgacgacgacacgtacgtactaacgtagtacggagagtacggacgttacggaccgtaggaacgtactcgtacgaaccgaccgtaaccgggtcgttcgttagtttccgtggtcggaacggaagggacggggtacgggggccggtaacgggggtcggttacgggggttcgggttaacgggttgggttcggtttcgttttacggagtttacggtaacggggttcggggtaaacccgg

SEQ ID NO: 378141 - DNA, 541 bp, Homo sapiens
  misc_feature: GZ8MTXP01DCJJJ.38.26.C04.1.454.CMB.2.raw
  modified_base (468)..(468): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtccccctgcaaggcttctggaggcaccttcagcacctatactttcagctgggtgcgacaggcccctggacaagggcttgagtggatgggagggatcctccgatctttggcaaaccacacctacgcacacaagttcccaggcagactcacgattaccgcggacgaactccacgagcacagtctacatgagatgagtagccgtgagatctgacgacacggccgtgtatttctgcgcgagnggacgggggccgagggggcttcgggttggttaacggttaaggtgtcgttttgagttagtcgttggggtaaccg

SEQ ID NO: 378142 - DNA, 617 bp, Homo sapiens
  misc_feature: GZ8MTXP01D8SWR.38.26.C04.1.454.CMB.2.raw
  modified_base (470)..(470): a, c, t, g, unknown or other
  modified_base (498)..(498): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacacggcccctggacaagggcttgagtggagtggggagggactccgtccgatcgtttcggacaaaccacacctacgacacaacaacgttacccagccagacctcaacgacgttacccggacggaacgaactccgacggacgcacagtactacagtggagatgaacgtagccgtagagattcgngaccgacgacggtccgtgttactttcgnggtcggcggaagggagggacgggggccgaacggggggtccgttacgggggttacgggttaaccgggtttaagggtcggtttaacgttttggaagttcgttcggttcgggggtaaaccgg

SEQ ID NO: 378143 - DNA, 585 bp, Homo sapiens
  misc_feature: GZ8MTXP01AKUVZ.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccagggggctcggtggtaacgttaggtgtcttttgaattatcgtggggccaaaggggacaagtgggtcaccgtctcctcacgcctccaccgaacggcccactcggtccttccccctcggccacccctcccgtccaacgtacgcacccgtcgtcgggggccaccgacggccggcccgtcggggcctcggcccttgggtccaacgggtactacttccgttacttcgaatcgaactgaggcgggcgttggaacg

SEQ ID NO: 378144 - DNA, 624 bp, Homo sapiens
  misc_feature: GZ8MTXP01CWKVU.38.26.C04.1.454.CMB.2.raw
  modified_base (295)..(295): a, c, t, g, unknown or other
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagttctggtgcaggacggtgaggacgctgaccacacggtacgtgctgttgtactgctcctccgatctttggacaaaccacactacgcacacaagttccaggacagactcacgattaccgcgacgaatccagagcacagtctacatggagatgagtagcctgacgatcngacgacacggccgtgtatttcngtgcgaggaggagggggccaaggggcgtcggtaggtaaacggttggtgtcgttttagaattagtcgtaggggaccaaaggggacaagtcgggtccaccgtctcctcacgcctaccgaccgaacggccctagtccggtccttccccgtcgaccacccctcctaccgaaacgacgcccaaccgtcggcggggaccacgacggtcccggcccgtcgggcctcggccgttcgggtaaccgaaacgggtacccttaaccgttaccgacggttcgtaacgtccgtaacgcggagggccgggtcgcggaaccgg

SEQ ID NO: 378145 - DNA, 583 bp, Homo sapiens
  misc_feature: GZ8MTXP01EAILV.38.26.C04.1.454.CMB.2.raw
  modified_base (326)..(326): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagnggagggggccagggggctcggtggtaacgttaggtgtctttgaattagtcgtggggaccaaagggacaagtcggtcaccgtctcctcacgcctaccaccgaacgggccctagtccggtccttcccctggcctacccctccgtaccaagacgccaccgtcgtcgggggccacgcgtccggcccgcgggcctggccgttggtaccaacggtctacgttccgcgttcgaactcggctcgggaggcgggtcgttgggaacg

SEQ ID NO: 378146 - DNA, 603 bp, Homo sapiens
  misc_feature: GZ8MTXP01DDPAW.38.26.C04.1.454.CMB.2.raw
  modified_base (287)..(287): a, c, t, g, unknown or other
  modified_base (452)..(452): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagccgtgggtcctcggtgaacggtcccctgcaaggcttcgtggagctaccttcagcactatacttcagcgtggtcncgacgacggcccctaggacgaagggtcttggaggtggagtggggacggactccgtccgattcgttacggaccaaaccgacaacctacgacacaactaacgtaccagaacagactacacgacttaccgacgaacaactcgacgagacaacagtactacgagtaganagtagagtacgaccgtagaagtactacgacggaacgaccgacggtaccgttgttacttcgtagtggaacgagggagggacggggcgaggggtcgttacgggttggttaacgttggtgttaacgttttggacttcgtcggttcggggtaacg

SEQ ID NO: 378147 - DNA, 644 bp, Homo sapiens
  misc_feature: GZ8MTXP01EVBPE.38.26.C04.1.454.CMB.2.raw
  modified_base (285)..(285): a, c, t, g, unknown or other
  modified_base (472)..(472): a, c, t, g, unknown or other
  modified_base (569)..(569): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctgggggctggaggtagaagaacgctgggggtccctcgggtgaagggacccctcgcaaggcttctggaggcaccttcagcacctatactttctagcngggtgcgacaggcccctcggacaagggcttgagtggatgggggcggagtcctcccgacgtcttgtcgaaccaccactacccgacacaacaacgtaccgaacgacgaacgactcacgacgtaccgacggacgcaaactacccaccgaacgacgaccacgtactacataggaggagtagacgtagccgntaggagacgtcgtacggaaccggaaccggtaccgggtccggttagttacgtttcgttgggtcggacgggagggacggggacgggggtaccgggtccnggggggttcgggttaccggggtttaaggggtacggttaacggtttggtacgttttaggtaacgttaacgggtccg

SEQ ID NO: 378148 - DNA, 709 bp, Homo sapiens
  misc_feature: GZ8MTXP01EBZRW.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggagggggccgaggggcgtcgggtggtaacgttaggtgtcttttgaattagtcggtagggggacccgaaaggggactaaagttcgggtacctaaccccgggttcctcccgttaccgacgtccccgttacccgaaccccgtaaaccggggtaccccgtacgttccccggggttccctttcccccccgtcgggtcccctaaacccccgttcccttaaccccgaaacgtaccggacccgacccgttaccggtcgggggaccaaccgcggcccggcccggtcggggccgtcggtcccgttcgggtaccgttaaacggtacccgttaaccgttacccgcggttacgccgtacgtaacccgtagggcggcggggtcgttcgggaaccggg

SEQ ID NO: 378149 - DNA, 685 bp, Homo sapiens
  misc_feature: GZ8MTXP01DVCTT.38.26.C04.1.454.CMB.2.raw
  modified_base (277)..(277): a, c, t, g, unknown or other
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatgganatgagtagcctgagatctagacgacacggcgttgtatttcngtgcgaggagggagggggccaggggctcgggtaggtaacggttaggtgtcttttgaattagtcggtaggggaccaaaggggactaagtcggtaccacccgtctcctcacgccctaccgaaccgaaccgggccctacgttcccggtaccccttcccccgtcggacccctacccccgttacccgtaacccgaaacggtacccgacccgtaacccgttcccgggtacgggggacccaaacccggccgggccccggtcccggtcggggtccgtccggtcccggttagggtaaccgaaacggtacccttaccgttaccgacggttacgtaacgttccggaacgtcgggacgggccgggtcgttcgggaaccg

SEQ ID NO: 378150 - DNA, 562 bp, Homo sapiens
  misc_feature: GZ8MTXP01ERP1O.38.26.C04.1.454.CMB.2.raw
  modified_base (467)..(467): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggagtgggagggatcccgtcccgatcgtttggacaaaccacacctacgcacacaacgtccaggcagactcacgattaccgcgacgatccacgagcacagtctacatggagatgagtagccgtagagatcgtgaccgacgacggccgtgtatttcgngtcgcggtaggagggacgggggcccgagggggtcgttggggttgggttacgggtttaagggtgttcgttttggagttagtcgttgggggaaccgg

SEQ ID NO: 378151 - DNA, 728 bp, Homo sapiens
  misc_feature: GZ8MTXP01ATCYH.38.26.C04.1.454.CMB.2.raw
  modified_base (294)..(294): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgataccgcgacgaatccacgagcacagtctacagtggagatgagtagcctgagatcngacgacgacggtccgttgttactttcgtggtggacggaagggacggggacgggggccgagggggtcgtacggggttacgggttaacggtttgggtgttcgttttaggaagttacgtcgggtacggggaacccgtaaaggggaactaaggtcggtacccgtacccgtcctcccgtacgaccgacccgtacccgaaccggtaaccgggcccctacgttcccggttccccttcccccgtcggacccctaccccgttacccgtaaccgaacggaccgtacccgtacccgtccgggtcgggggaccaccggccgggtcccgggtcccggtcggggtccgtccggtcccggttacgggtaaccgttaaccgggtaccttaccgttacccgacggttacgtaacgtcggtaaccgtcgggacggccgggtcgcgggaaccg

SEQ ID NO: 378152 - DNA, 608 bp, Homo sapiens
  misc_feature: GZ8MTXP01CY1P6.38.26.C04.1.454.CMB.2.raw
  modified_base (407)..(407): a, c, t, g, unknown or other
  modified_base (427)..(427): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggagcaccttcagcactatacttcagctggtgcgacgagccccctggaccaaggcttggaagtggagtggggaagggctccgtcccgattcgttggacaaaccacacctacgacacaacaacgtccaaggcagactacacgacgtaccgcgaacgacncacgacgcacagtacctaanagagagagtagagtacgcgtagagtactacgtagaccgacgtacggtaccgttgttacgttcgtaggtcggaacgggtagggacggggacgggggaccggtaggggtcgttacggggttacgggttaacggtttaagggttacgttcgtttaggacggttacgtcgggttaacgggtaacg

SEQ ID NO: 378153 - DNA, 557 bp, Homo sapiens
  misc_feature: GZ8MTXP01B0T40.38.26.C04.1.454.CMB.2.raw
  modified_base (531)..(531): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtccttgtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccagggggctcgggtcggtaacgttaggtgcttttgaatatcgtggggccaaagggacaagtggtcaccgtctcctcacgcctccacgaacgggcccatccggtcttcccctggccaccccgtctcaagcgccacctcgtcggggccacgacgccggccctgggctcgccgttggcaacggactacttccgcgttgntcgaacgtggcgcgggcgttggaacg

SEQ ID NO: 378154 - DNA, 642 bp, Homo sapiens
  misc_feature: GZ8MTXP01EGXGO.38.26.C04.1.454.CMB.2.raw
  modified_base (131)..(131): a, c, t, g, unknown or other
  modified_base (500)..(500): a, c, t, g, unknown or other
  modified_base (605)..(605): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggnggttcctctttgtggtggcagcagctacaggtgtccagtcccaggtgcagttggtgcagtctggggctgaggtgaagaagcctgggtctcggtgaaggtcccctgcaaggcttcgtggagcaccttcagcacctatactttcagcgtgggtcgcgaccgacggccccctggaccgaagggcttggaggtggagtggggagggactcccgtcccgattcgttggacaaaccacacctacgcaacacaacgttacccaaggaaccacgacctacgaccgacgttaacccgggctaaaccgaaactacccgaacggaacgaccaaccgtagtacctaacagtaggaagtagtagagtacgaccgtgaacgtntacgagaaccgaccgtacggtccgttagttacttcgcggcggaacggagggacgggacggggttccggtagggggtacgttcggggttaggttaacgggtttggngtttcgtttagagttacggtcgggttcgggtaaccgg

SEQ ID NO: 378155 - DNA, 665 bp, Homo sapiens
  misc_feature: GZ8MTXP01DZIVW.38.26.C04.1.454.CMB.2.raw
  modified_base (277)..(277): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatgganatgagtagctgagatctgacgacacggccgtgtatttctggtgcgagaggagggggccaggggctcgggtagtaacggttaggtgtcttttgaattagtcggtggggaccaaaggggtaccaaagtcgggtacctacccgtctccgtcacgccctacccgaaccgaaacgggccctacgttccggtcccttcccccgtcggaccctaccccttcctaacccgaacgaaccgccgaacccgtccggtcgggggaccaacggccgtccgggcccgtcgggtccgtcgtcccggttagggtaccgttaaacgggtacccttaccgttacccgttacgttacggtaacgttccggaaccgttgggacgggccggggtccgttcggggaaccg

SEQ ID NO: 378156 - DNA, 630 bp, Homo sapiens
  misc_feature: GZ8MTXP01BDWQE.38.26.C04.1.454.CMB.2.raw
  modified_base (232)..(232): a, c, t, g, unknown or other
  modified_base (239)..(239): a, c, t, g, unknown or other
  modified_base (250)..(250): a, c, t, g, unknown or other
  modified_base (257)..(257): a, c, t, g, unknown or other
  modified_base (489)..(489): a, c, t, g, unknown or other
tcagtcgatcacgtcacgaccggtgctcgatttagtctagcgactttgggtttggggatcacataacaaccacattcctcctctaaagaagccctgggagcacagctcatcaccatggactggacctggaggttcctctttgtggtggcagcagctacaggtgtccagtcccaggtgcagttggtgcagtctggggctgaggtgaagagctgggtctcggtgaagtccctgnagcttcnggagcaccttngcacctntacttcagctgggtgcgacgcggcccctggacgaagggcttgaggtggagtggggacggtactccctcccggtagttctttaggaccaaaaccgcaaccccttacggcaacacgtaaacgttccgaacggaacaggacctacgaccgtaacgttaccccgggcgaaacgaactccgacgacgacaccagtactacagtcggagtagagtagtacgacgtagaggactcgtanaccggacgacggtccgttgttacgttcgtaggtggaaccggtaaggacggggtacgggggccgtaagggggtccgttgggggttacggttaacggtttaacgggtgttccgttttagagttacgtcggttcgggggaaccg

SEQ ID NO: 378157 - DNA, 621 bp, Homo sapiens
  misc_feature: GZ8MTXP01CNGV6.38.26.C04.1.454.CMB.2.raw
  modified_base (325)..(325): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctagagatctgacgacacggccgtgtattctgtgcgagnggagggggccaggggtctcggtaggtaaacggttaggtgtcttttagaattagtcggtggggtaacccaaaggggaccaaagtcggggtaccaacccgtcgtccctacacgtccctacccaaccgaacgggtccctacgtccggtccttcccctcggccctaccccgtcctaccaacgacgccgaccgtcgtcgggggcacgacgtccggcccgtcgggcctcggccgttcggtcgaacggtacctacgttccgacgttgtaactcggaacgtggacgttcgggcgttcggaacgg

SEQ ID NO: 378158 - DNA, 600 bp, Homo sapiens
  misc_feature: GZ8MTXP01AJKAR.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggagggggccaggggctcggtggtaacggttaggtgtctttgaattgtcgtggggaccgaagggacaagtggtcaccgtctctcacgcctccacgacgggccacgtccggtccttcccccgtcgccctacccctccgtaccgaacgacgccaccgtcgtcgggggcacgacggccgacccgtgggcctcggccgttcggtaccgaaacgggtacccttaacgttcccgcgttcgaacgtccggaacgtcggacggccgggtcgttcgggaaccgg

SEQ ID NO: 378159 - DNA, 678 bp, Homo sapiens
  misc_feature: GZ8MTXP01CQM9K.38.26.C04.1.454.CMB.2.raw
  modified_base (362)..(362): a, c, t, g, unknown or other
  modified_base (457)..(457): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagctgggtcctcggtgaacggtcccctgcaaggcttcgtggacggctaccttcagcacctatactttcagcgtgggtgcgacacggcccctggacaagggcttggagtggagtgggggaggactcccgtccgattcgtttcggaccaaaccncacctacgcacacaacgttacccaggaacagactacacgactaccggacggacgaactaccaacgacgacaacgacgtcctaacagtacgggaanagtcggaagtacggccgtaggaggtacttacgtacgaaccggaccgtaccggtaccgttgttaacgtttcggtacggttggaaccggtaaagggagggggtacgggggcccggtaacggggggtccgttacggggggtttacgggttaaaccgggtttaaggggttcggtttaacgttttagggacttacgggttaacgggttaacgggggtaaacccggg

SEQ ID NO: 378160 - DNA, 598 bp, Homo sapiens
  misc_feature: GZ8MTXP01AXJKA.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggagggggccagggggctcggtggtaacgttaggtgtcttttgaatagtcgtggggccaaaggggacaagtggtcacccgtctcctcacgccctccaccgaaacgggcccacgtccggttccttcccccgtcggcccacccctccctaccaacgacgcctacccgtcgtgggggccacgcggcccggcccgtcgggcctgccgttcgggtccaacgggtacctaccttccgacggttgaactcgaaccgtggacggcgggcgttgggaaccg

SEQ ID NO: 378161 - DNA, 626 bp, Homo sapiens
  misc_feature: GZ8MTXP01A24CE.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtattctgtgcgagaggagggggccaggggctcggtggtaacgttaggtgcttttgaatagtcgtggggccaaggggacaagtcgggtcaccgtctcctcacgcctccaccgaacgggcccagtccgggtccttcccccgtggcccaccccttcctacccgaacgacgacccgacccgtcgtcgggggaccaccgacggcccgggccccgtggggcccgtcggcccgttcgggtcccgaaaacgggtcccttacgttccccgacggttcggaacttacgggaaccttgggacggccgggggtccttcggggaaccgg

SEQ ID NO: 378162 - DNA, 555 bp, Homo sapiens
  misc_feature: GZ8MTXP01B7UBH.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggagggggccaggggctcggtggtaacgttaggtgtctttgaatagtcgtggggccaaggggacaagtgggtcaccgtctctcacgcctccaccgaacgggcccatccggtccttcccctcggccaccctccgtccaagacgcaccgtcgtcggggcacgacgccggccctgggctgccttggtcaaggactacttccgcgttgaatcgaactgagcgggcttggaacg

SEQ ID NO: 378163 - DNA, 655 bp, Homo sapiens
  misc_feature: GZ8MTXP01EG2KT.38.26.C04.1.454.CMB.2.raw
  modified_base (438)..(438): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttcgtggaggcacttcagcactatactttcagctgggtgcgacgacggcccctggacaagggcttgagtggagtggggagggactcccgtcccgattcgtttggacctaaaccgacaccctaccgacgaacaaccaaaggttcccaaggaaccgagtaacctccgaacgtacgttaacccggcggaaaccgaaacncccgaacggacggaccaacaacggttccttaacgagtaggaagagtaggaagtacgaccgttaggaacggtacttaccgaggaaccgaaccgaacgggtacccgttgttaacgtttcctacgggttgaaccggaggacggggagggggttcccgaaggggtcgttcgggttgggttacggttaaggtgtcgtttggagttagtcggttgggaaccgg

SEQ ID NO: 378164 - DNA, 614 bp, Homo sapiens
  misc_feature: GZ8MTXP01EDG9U.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggagggggccagggggctcgggtggtaacggttaggtgtcttttgaattatcggtggggaccaaagggacaagtcggtcaccgtctcctcacgcctccaccgaacgggccctagtccggtccttcccccgtcggccctacccctcctacccgaacgaccgccaccgtcgtcgggggccaaccgcggccggcccgtcgggcctcggccgttgggtaccgaacgggtacccttaccgttccgcggttacgaacgtcggaacgtgggacggccggggtcgttcgggaaccgg

SEQ ID NO: 378165 - DNA, 640 bp, Homo sapiens
  misc_feature: GZ8MTXP01A7XHW.38.26.C04.1.454.CMB.2.raw
  modified_base (422)..(422): a, c, t, g, unknown or other
  modified_base (444)..(444): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctgggtcctcggtgaacggtcccctgcaaggtcttcgtggagcaccttcagcacctatacttcagtcgtggtgcgacgacggccccgtggacgagggctgaggtggagtggggacggtactccgtccgtattcgttacgaccaaaccacacccgtacgacacactacgtaccaaggcacactacacgactacgacgacactccgaaganacacagtactacgatacggganagtaggagtacgcgttaggactactcgtacgaaccgacgtaccggtacggttgttaactttcgtggtacggaacgggaacggttacgggggaacggggcccggaagggggtcccgttagggggttacgggttacggtttaagggtcggtttaacggttttaggacgtttacggtcgggttaacggggtaacccggg

SEQ ID NO: 378166 - DNA, 618 bp, Homo sapiens
  misc_feature: GZ8MTXP01BZ7LO.38.26.C04.1.454.CMB.2.raw
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggcgtgtatttcngtgcgagaggagggggccaggggctcggtaggtaacgttaggtgtcttttgaattagtcgtggggaccaaaggggacaagtcgggtcacccgtctcctcacgcctaccaccgaacgggcccacgtccggtccttccccgtcggcctaccccgtcctaccaagacgccaccgtcgtcgggggcaccgacgtccgggcccgtcgggctcggcccgttgggtaccgaaacgggtaccttaccgttacccgttaccggttgtaacgtccggaacgtcgggacggccggggtccgttgggaaccgg

SEQ ID NO: 378167 - DNA, 589 bp, Homo sapiens
  misc_feature: GZ8MTXP01EV4TO.38.26.C04.1.454.CMB.2.raw
  modified_base (319)..(319): a, c, t, g, unknown or other
  modified_base (330)..(330): a, c, t, g, unknown or other
  modified_base (451)..(451): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctagacgacacggccgtgtatttcngtgcgagaggngggggccaggggctcggtaggtacgttaggtgtcttttgaattgtcgtggggaccaaagggacaagtggtcacgtctctcacgcctaccacgaacgggcccacgtccggtccttcccccgnggcccacccctcctccaagacgccacccgtcgtcggggcaacgacgccggtcccgtgggctcggccttgggtaccaacgggtacctacctttccgacgttcgaactccgaacgtggacggcgggtcgttcggaaccgg

SEQ ID NO: 378168 - DNA, 556 bp, Homo sapiens
  misc_feature: GZ8MTXP01C3G1J.38.26.C04.1.454.CMB.2.raw
  modified_base (320)..(320): a, c, t, g, unknown or other
  modified_base (346)..(346): a, c, t, g, unknown or other
  modified_base (481)..(481): a, c, t, g, unknown or other
  modified_base (492)..(492): a, c, t, g, unknown or other
  modified_base (530)..(530): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctggtgaaggtcccctgcaaggcttctggagcaccttcagcacctatactttcagctgggtgcgacgaggcccctggacaagggcttgaggtggatgggaggntcctcccgattcgtttaggcaaaccncacctacgcacaccaagtcccaggcagactcaacgtagtacccgacggacgaactccgaacgagcctaacagtactacatgggagatgaacgttgccgtagagactctacgacgacgacggtccgtgtatttcgngtgcggaaggnggaggggccgaggggcttgggttggttacggttaaggngtcgtttgattagtcgttgggaaccg

SEQ ID NO: 378169 - DNA, 635 bp, Homo sapiens
  misc_feature: GZ8MTXP01D5TWC.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcggtgaacggtcccctgcaaggtcttcgtggaggcaccttcagcacctatactttcagtcgtgggtgcgacgacggcccccgtaggaccgaagggtcttggaggtggagtgggggagggtactcccgtcccgtattcgtttacggacaaaccacaacctacgacaacacaacgttaccaaggcacgactacacgtacgtaccggacgtaacgaactccaacgagacaacagtactacagtggagatgagtagccgtagaagtatacgtacgaccgacgtacgggtccgttaggttactttcgtggtggaacggaggaggggtacgggggccgtaagggggtcgttcggggttagggttaacggtttaagggtggttcgttttggagttacgtcgggttaacggggtaaccgg

SEQ ID NO: 378170 - DNA, 579 bp, Homo sapiens
  misc_feature: GZ8MTXP01DTS0Q.38.26.C04.1.454.CMB.2.raw
  modified_base (424)..(424): a, c, t, g, unknown or other
  modified_base (462)..(462): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctcttttgtggtggcagcagctacaggtgtccagtcccaggtgcagttggtgcagtctgggggctgaggtgaagaagcctgggtcctcggtgaaggtcccctgcaaggcttctggagcaccttcagcacctatactttcagctgggtgcgacaggcccctggacaagggcttgagtggatgggaggatccctcccgatctttggacaaaccacacctacgcacacaagttcccaggcagactacacgacttaccgcggaacatccacgagcacagtactacagtaganatgaagtacgcgtagagatctagaccgacacggccgtnttatttcgtgtgcggaggacgggcgggggacccgagggggtcgttacgggggttaggttaaccgggtttaagggttcgtaacgtttttgagttagttccggttgggggtaaacccgg

SEQ ID NO: 378171 - DNA, 614 bp, Homo sapiens
  misc_feature: GZ8MTXP01AI07D.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgaggagggacgggggccgaggggcttcgggtcggttaaacggttggtgtcgttttgaattagtcggtggggaccaaagggacaagtcggtccaccgtctcctcacgccctccgaccgaacggcccagtccgtccttccccgcggcctaccccgtcctaccgaacgcgcctaccgtcggtcggggccacgcgcccgggtcccgtgggcctcggccgttgggtaccgaacggtaccctacgttccccgaggttcgaacgtcggtaacgtcgggacggccggtcgttcggaacgg

SEQ ID NO: 378172 - DNA, 656 bp, Homo sapiens
  misc_feature: GZ8MTXP01D6186.38.26.C04.1.454.CMB.2.raw
  modified_base (634)..(634): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctcttttgtggtggcagcagctacaggtgtccagtcccaggtgcagttggtgcagtcgtggggctgaggtgaagagcctgggtcctggtgaaggtcccctgcaaggcttcgtggaggcaccttcagcacctatactttcagcgtgggtgcgacgacggcccccgtggaccgaagggtcttggaggtgggagtagggggacgggtactcccgttcccgagttcgtttcggaccaaaccctacaaccctaccgacaacaaccaacgttacccaaggaacacgacctacgaaccgtacgttaacccggacgggaaaccgaactacccgaacggacgaccaacgaacgttacctaacaagtcgggaagagtaggaacgttaacggccgttaggagtactacgtagaccgacgaccggtccgttagttatttcgtggtggaacgaggagggagggggcgaggggtcgttcggggttggttacggttaaggtgtcgttttaggnttaggtcggttcgggtaaccgg

SEQ ID NO: 378173 - DNA, 577 bp, Homo sapiens
  misc_feature: GZ8MTXP01EN0UF.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttcgtggaggcaccttcagcacctatactttcagctgggtgcgacacggcccctggacaagggcttgagtggagtggggaggactcccgtccgatcgtttggactaaaccgacaaccctacgacacacaacgttacccaggcagactcacgactaccgcgacaactccacgagcacagtactacatggagagtgagtagcgtagagtatcgtagaccgacgacggtccgttagttatttcgtggtgaacggaggacgggacgggggcgaggggtcgttcggggttcggttaacggtttgggtgttcgttttggagttagtcggttggggtaaccg

SEQ ID NO: 378174 - DNA, 722 bp, Homo sapiens
  misc_feature: GZ8MTXP01BPWYR.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagccgtgggtcctcgggtgaacggtcccctgacgaaggtcttcgtgggaggcctaccttcacgcctacctattactttcgagcgtgggtcgacgacgacggcccccgtaggaaccgaagggtcttaggaggtagggtaaggtgggggacgggtaccttccccgtacccggtagttccgtttacggaaccaaaacccgtaccgaacccctaccggacaaccaaacgtaaccggttaacccgaacgggaaccacgaacctaccaaaccgtaacgttaacccgggacggtaaaccgaacgtacccgaacggaacgactaaccgacgttaccaacgtacgtgggaagttagtagaagtacgtccgtaaggacgtactcgtaacgaccgaccggtaccggtaccgtttagttacgtttcgtggtcggaacggaagggagggacgggggccggtaggggtccgttagggttggttaacggtggtgtgttttagacgttacgtcggttaacgggaacg

SEQ ID NO: 378175 - DNA, 574 bp, Homo sapiens
  misc_feature: GZ8MTXP01DZMCA.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttctggaggcaccttcagcacctatactttcagctgggtgcgacaggcccctggacaagggcttgagtggagtgggagggactcccgtccgattctttggccaaacacacctacgcacacaagttcccaggcagactcacgattaccgcggaacatccacgagcacagtactacatggagatgagtagccgtagagactcgtagacgacgacgggccttgttatttcgcgttggaacgaggagggacgggggaccgagggggtcgttccggggttgggttaaaccggtttgggttcgtcgtttttgacgttacgtcggttcgggggtaaccgg

SEQ ID NO: 378176 - DNA, 641 bp, Homo sapiens
  misc_feature: GZ8MTXP01C5WJH.38.26.C04.1.454.CMB.2.raw
  modified_base (393)..(393): a, c, t, g, unknown or other
  modified_base (416)..(416): a, c, t, g, unknown or other
  modified_base (449)..(449): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctcttttgtggtggcagcagctacaggtgtccagtcccaggtgcagttggtgcagtcgtggggctggaggtgaagaagcgtgggtcctggtgaacggtcccctgcaaggcttcgtggacggcaccttcagccacctatacttcagcgtgggtgcgacgacggccccgtaggaacgaagggtcttaggagtgggagtggggaggctcccgtcccgattcgttagaccaaaccacacctacgacacacacgtacagcanactacacgataccgcgaacaacnccacgacgcaacgagtactaacgagtagggaanagtacgaacgtacgacggtagaagtctacgacgaaccgacgtacgtaccgttagttacgttcgtggtacggaacgggtaacgggacggggtacggggaccggtaaggggtccggtttacggggttacgggttaacgggtttgggttacgtttaacggtttagagttacggtaaccgggttcggggtaaccgg

SEQ ID NO: 378177 - DNA, 640 bp, Homo sapiens
  misc_feature: GZ8MTXP01EEM5L.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgaggaggagggggccgaggggctcgggtcggtaacggttaggtgtctttgaatgtcgtggggccaagggacaagtcggtcaccgtctctcacgcctccacgaacgggcctacgtccgggtcccttcccccgtcggccctacccctcccgtacccgaaacggaccgaccgtaccccgtccggtcggggggccaaccgccgcccgggtccccgtcggggccgtccggtccgttcggggtaaccaaacggggtacccttaaccgttcccgttaccgttacggccgtacgccgttggacgggccgggtcgttcgggaaccgg

SEQ ID NO: 378178 - DNA, 595 bp, Homo sapiens
  misc_feature: GZ8MTXP01A5ARL.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacacggcccctggacaagggcttggagtggagtggggagggactcccgtcccgattcgtttacggaccaaaccacaccctacgcacacaagtacccaggaacagactcacgacttaccggcgacgactccgacgacgcacgagtactacagtggagataggagtagccgtgagatcgtagacgaccgacggtaccgtgttacgtttcgtgtcggcggaaggagggacgggggccgagggggtcgttacggggttggttaacgggttaaggtcggttcgttttagggattacggtcggttgggggaacccgg

SEQ ID NO: 378179 - DNA, 779 bp, Homo sapiens
  misc_feature: GZ8MTXP01AFJMD.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggtcttcgtggaggcaccttcagcactatacttcagctgggtgcgaccgacggcccctaggaccgaaggggctttaggaggtggagtgggggacgggtactcccgtcccgtagttccgtttacggaccaaaaccgacctaacccctaccggacaaccgaacctaaggttaacccgagggaacacggacctacgaaccgtacgttaacccggacggaaaccgaactacccgaacgacgaccaacgacgtactaacagtaggaagagttaggaacgttacggacccggttaggaacgtacgttaccgtacggaaccggtaccggtaacccgggttcccgtttagttacgttttacccggtgggttacggggtaacccgggaacgggggaagggggtacccgggggggacccggtaacgggggggttacccggttacggggggttaacggggtttaaacccggggttttaaggggttccggtttggtttttaccgggaggttttaaccggtcccggggtttaacggggggtaaaccccgggg

SEQ ID NO: 378180 - DNA, 543 bp, Homo sapiens
  misc_feature: GZ8MTXP01EO5K4.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatcccgtcccgatctttggcaaaccacacctacgcacacaagttcccaggcagactcacgattaccgcggaacgaatccacgagcacagtactacatggagatgagtagccgtagagatctgaccgacacggccgtgtatttctgtgcgagaggagggggccgagggggcttcgggttggttaaacggttggtgtcgttttgattagtcgttggggaaccg

SEQ ID NO: 378181 - DNA, 633 bp, Homo sapiens
  misc_feature: GZ8MTXP01COPKO.38.26.C04.1.454.CMB.2.raw
  modified_base (315)..(315): a, c, t, g, unknown or other
  modified_base (326)..(326): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagtccaggacagactcacgattaccgcgacgaatccacgagcacagtctacatggagatgagtagcctgagatctgacgacacggccgtgtattcngtgcgagaggnggggccaggggctcggtggtaacgttaggtgtctttgaatatcgtaggggccaaaggggacaagtcggtacacccgtctcctcacgcctacccaacccgaacgggccccagtcccggttcccttccccccgtcggaccctaccccgtcccgtacccgaaacggacgccgtacccgtccggtcgggggaccaaaccggcggcccgggtcccgtcggggcctcggtccgttcgggttacgaaacggtacctaccgtttacccgcggttcgaacttaccgcgtggacggcggggtaacgttcgggaacgg

SEQ ID NO: 378182 - DNA, 670 bp, Homo sapiens
  misc_feature: GZ8MTXP01A7LE9.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggcttcgtgggaggcaccttcagcacctatacttcagctgggtgcgacacggcccctaggacaagggcttggaggtggagtgggggaggactcccgtcccgatcgtttggacaaaccacacctacgacacacaacgttcccaaggcagactacacgtaacgttacccggaggtaaccgaactacccgaacgtacgacaccgagtacctacgaagtggaagataggaacgtacgaccggtagacggtatccgtaggaacccgacgaaccggtccgttacgttacgtttccgttggttggaaccgggaagggaggggaacggggggcccggtaacgggggtccggttacggggttacggggttaaccggtttaaggggttgttcggtttttaggacgtttaaggtccgggtttaagggggtaaacccggg

SEQ ID NO: 378183 - DNA, 544 bp, Homo sapiens
  misc_feature: GZ8MTXP01A3620.38.26.C04.1.454.CMB.2.raw
  modified_base (464)..(464): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggagcaccttcagcacctatacttcagctgggtgcgacaggcccctggacaagggcttgagtggatggggaggatcctccgatctttggacaaaccacactacgccacacaagtccaggaacagctcacgataccgcggacgaatccacgagacacagtctacatggagatgagagcctagaggatcgtagacgtacgacgccgtagtatttctgtgcgnggaaggagggggcaggggcgtcgggtaggttacggttgggttgtcgtttgaattagtcggttggggccgttaagggaacg

SEQ ID NO: 378184 - DNA, 587 bp, Homo sapiens
  misc_feature: GZ8MTXP01D6P91.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttcgtggaggcaccttcagcacctatactttcagctgggtgcgacacggcccctggacaagggcttgagtggagtggggaggatcccgtccgatcgtttcggacaaaccacaccctacgcacacaacgtcccaggcagactacacgactaccgcggaacatccacgagcacagtactacagtggagatgagtagccgtagagtatcgtgaccgacgacggccgttgttaactttcgtggtcggaacgtaggagggacgggggcccgaagggggtcgttacggggttcgggttaaacgggtttgggttcgtcgttttaggacgttacgttcggttcgggggtaaccg

SEQ ID NO: 378185 - DNA, 636 bp, Homo sapiens
  misc_feature: GZ8MTXP01BEC2N.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctcggtgaaggtcccctgcaaggcttctggaggcaccttcagcacctatactttcagctgggtgcgacgacggccccctggacaagggcttggaggtggagtggggagggactcccgtacccgtattccgtttaggaccaaaccacaaccctaccgacaacacaacgttaccaggaacagactacacgacttaccggcggaacactacccacgacgccaacaggtacctacagtaggagatagaagtacgcgtagaagtatacgtacgaaccgacgaccggtaccgttgttaacgtttcgtcggtggtaacgggaagggttacggggacgggggccggtagggggtcgttcggggttagggttaaccggttaagggttcgtaagttttggagttacgtcggttcggggtaacccgg

SEQ ID NO: 378186 - DNA, 672 bp, Homo sapiens
  misc_feature: GZ8MTXP01AOMEL.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagcgtgggtgcgacgacggcccctggacgaagggcttggaggtggagtggggagggtactcccgtcccgtattcgtttacggacaaaccacacctacgcaacacaagttaccaaggaacagacctacgacgtacgtacccggacgaaccgtaactcccgaacggacgaccgaacgtacgtactaacgagtagggaagtaatggaacgttacgaccggttaggacgtacgtacgtaggaaccgtacgaccgggtacgtttacgttaacgtttccgtaggttcggaacggagggacgggtacgggggaccgtaacgggggtccgttacgggggttacgggttaaaccggttgggtgttcgttttaggtacgttacggttaacggttcgggggtaaaccg

SEQ ID NO: 378187 - DNA, 781 bp, Homo sapiens
  misc_feature: GZ8MTXP01B196Z.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaacggtcccctgcaaggcttcgtggacggcaccttcagcacctatactttcagcgtgggtgcgacgacggcccctggacgaagggcttgaggtggagtggggaggactcccgtcccgtattcgtttacggaccaaaccaccaccgtaccgacacactaacgttcccaaggcagacctacaacgacgttacccggacggtaaccgaactacccgaccggaacgaccgaacgtacgtacctaaccgagtagggaagtagtacggtaaggttaaccggcccggtaaggtaacggtaacgtaccgttacgggaacccggaacccgtacccggggttaccccggtttaggtttaaaccgttttccggttagggttcgggaaccgggtaaacggggttaacggggggtacgggggggaccccggtaaaggggggggtcccggtttaccggggggttacggggtttaaacccggggtttttaagggggttcgggtttaacccggttttttaggggtaacgttttaaacgggtttccggggttaacggggggttaaaccccgggg

SEQ ID NO: 378188 - DNA, 576 bp, Homo sapiens
  misc_feature: GZ8MTXP01D18FF.38.26.C04.1.454.CMB.2.raw
  modified_base (437)..(437): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaaggtcccctgcaaggcttcgtggaggcaccttcagcacctatactttcagctgggtgcgacacggcccctggacgaaggcttggagtggagtgggagggatcccgtccgattctttggacaaaccacacctacgcacacaacgtacccagaacagactacacgacttacgcggaacaactccacgagcaacagtactacaagtgggaanagagagtacgcgtagagtactacgacgacgacgacggtacgttagtgttgtgtggaacggaggagggacggggacggagggtcggttcgggttacggttacggttggtgttcgtttgagttacgtcggttcgggtaacg

SEQ ID NO: 378189 - DNA, 681 bp, Homo sapiens
  misc_feature: GZ8MTXP01CPD0K.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcgtgggtcctcggtgaacggtcccctgcgaaggcttcgtggacgcctaccttcagccacctatactttcgagtcgtgggtcgacgacgacggccccgtaggaaccgaagggtcttggaggtggagtgggggacggtctcccgtccgattcgttacggacctaaaccacaaccctacgacacaactaacgtaccaggaacagactacacgtaacgtaccgacggtaacaactccgaacgacgacaacgagtactaacgagtagggaaatagtaggaacgtacgacgtagaagtacgtacgacgaaccgtacgtaccggtacgttacgttacgtttcgtacggtcggaacgggtaacgggacgggggtaccgggggttacggtacgggggtcgggttacggggttacgggttaacggttgggttacgttcgttttaggtacggttacggttaacgggttaacggggtaacgg

SEQ ID NO: 378190 - DNA, 562 bp, Homo sapiens
  misc_feature: GZ8MTXP01EUI32.38.26.C04.1.454.CMB.2.raw
  modified_base (485)..(485): a, c, t, g, unknown or other
tcagtcgatcacgtcacgaccggtgctcgatttagtctagcgactttgggttttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacacggcccctggacaagggcttgagtggagtgggaggatcccgtcccgtatctttcggctaaaccacacctacgcacacaacgtccaggcagactcacgtactaccgcgacaatccagagcacagtactacatggagatgagtagccgtagagatcgtgaacgcgacggccgttgtatttctggtgcggtagaggngggggcccagggggtcgttacgggttggttaaccggttgggtgtcgttttggagttagtcggttaaggggaacccgg

SEQ ID NO: 378191 - DNA, 614 bp, Homo sapiens
  misc_feature: GZ8MTXP01DIWIL.38.26.C04.1.454.CMB.2.raw
  modified_base (468)..(468): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagaagcgtgggtcctcggtgaaggtccccctgcaaggcttcgtggaggcaccttcagcacctatacttcagcgtggtgcgacgacggccccctggacgaagggcttagaggtggagtggggaggtacttccgtcccgagttcgtttacggaccaaaccaccacccgtacgctaaccaacgtaacgttaacccagaacgagactacgacgacttaccgacgtaacgaactccaacgacgacaacacgtactaacagtagganagtagagtacgcgtagacgtatcgtagacgacgtacggccgttgtattctggtgaacgtaggagggacggggccgtaggggcgttcggggttaggttaaccgggttggttacgtcgttttgagttcgtcggttcggggtaacccgg

SEQ ID NO: 378192 - DNA, 566 bp, Homo sapiens
  misc_feature: GZ8MTXP01BFISI.38.26.C04.1.454.CMB.2.raw
  modified_base (427)..(427): a, c, t, g, unknown or other
  modified_base (443)..(443): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcactatactttcagctgggtgcgacaggcccctggacaagggcttggagtggagtgggaggatcccgtcccgatcgtttggaccaaaccacacctacgcacacaacgttaccaggcagactcacgacttaccgcgacgaactccaacgagacacagtctacatgganatgagtacgcgtgagntcgtagaccgacacgacgtccgtgttactttcgtgtgcggaggagggacgggggccgagggggcgttcgggttagggttaacggttagggtgttcgtttggttagtaagttcggtaacggggg

SEQ ID NO: 378193 - DNA, 599 bp, Homo sapiens
  misc_feature: GZ8MTXP01C4Y5N.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaacggtcccctgcaaggcttcgtggaggcaccttcagcacctatacttcagctgggtgcgacacggcccctggacaagggcttggagtggagtggggaggactcccgtccgattcgtttagaccaaaccacacctacgacacacaacgtacccaaggcagacctacacgactaccgacgaacgaactccgaacgacgccaactagtactaacgagtaggagagtagaagtacgccgtagagtactcgacgaccgacgacggtccgttgttatttcgtgtgaacggaggaggggacgggggccgtagggggtcgttacggggttggttaaaccggttgggtgttcgttttggacgttacgtcggttggggaaccg

SEQ ID NO: 378194 - DNA, 637 bp, Homo sapiens
  misc_feature: GZ8MTXP01AKOK1.38.26.C04.1.454.CMB.2.raw
  modified_base (364)..(364): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttcgtggaggcaccttcagcacctatactttcagtcgtgggtcgcgacgacggcccctggacgaagggtcttggagtggagtggggaggtactcccgtccgattcgtttaggaccaaaccncaccctacgacacaacaacgtaccgagcagacctacacgtacgtaccggacgaacgaactaccacgacgacaacacgtactacgagtggagtagtagagtacgccgtaggagtactaccgtacgacgaccgacgtacgtcccgttagttactttcgtggtcggacggagggacggggacgggggtacccggtaagggggttccggttccgggggttaggttaaccgggtttaggtcggttgttttaggagttaacggttcgggtaaccggggg

SEQ ID NO: 378195 - DNA, 603 bp, Homo sapiens
  misc_feature: GZ8MTXP01ECR3A.38.26.C04.1.454.CMB.2.raw
  modified_base (277)..(277): a, c, t, g, unknown or other
  modified_base (316)..(316): a, c, t, g, unknown or other
  modified_base (565)..(565): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgagacgaatccacgagcacagtctacatgganatgagtagcctgagatctgacgacacggcgtgtatttcngtgcgaggagggagggggccaggggctcgggtcggtaacggttaggtgtcttttgaattagtcggtggggaccaaagggacaagtcgggactacccgtctcctcacgcctaccgaccgaaacgggccctagtccggtcccttcccccgtcggacctacccctcctaccgaaacgacgccgaccgtcggcgggggcacgacggccgccgtcgggctcgccgttggcgttaaacggaccttacgttcccgngttacgcgtacgcgtggacggcgggtcgttcggaacgg

SEQ ID NO: 378196 - DNA, 684 bp, Homo sapiens
  misc_feature: GZ8MTXP01C0ESF.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaacggtcccctgcaaggcttcgtggaggcaccttcagcacctatacttcagctgggtgcgacacggcccctggacaagggctttggagtgggagtgggggacgggtactcccgtcccgattcgtttacggaccaaaccacaccctaccgacacaactaacgtacccaaggcacgacctccaacgacttacccgacggtaacgaactcccaacgacgacaaccgtagtacttacgagtaggaagagtggagttaacgccgtaggagtacttcgacgaccgaccgtacgggtccgttagttaacgttttccgcggcggaaccgggaagggacgggggtaaaccggggggcccggtaaaggggggtccgtttaacccgggggttggggtttaaaccggtttaaggggttcgttaaccggtttttaggacgttacggttccgggttaacgggggtaaacccggg

SEQ ID NO: 378197 - DNA, 589 bp, Homo sapiens
  misc_feature: GZ8MTXP01B4VZN.38.26.C04.1.454.CMB.2.raw
  modified_base (64)..(64): a, c, t, g, unknown or other
tcagtcgatcacgtcacgaccggtgctcgatttagtctagcgactttgggtttggggatcacanaacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggcttcgtggaggcaccttcagcacctatactttcagctgggtgcgacacggccccctggacgaaagggcttggagtggagtgggagggatcccgtcccgagttctttggacaaaccacacctacgcacacaacgttccagcagactcacgattaccgcggaacatccgacgagcacagtactacatggagatgagtagccgttgacgtatcgtagaccgtacgacggtccgtgttacgtttcgtcgtggcggaggttacggggagggggccgagggggtcgttcggggttcggttaaacgggttgggtcgttaagttttggagtttagtcggttcggggtaaccgg

SEQ ID NO: 378198 - DNA, 649 bp, Homo sapiens
  misc_feature: GZ8MTXP01C8PLP.38.26.C04.1.454.CMB.2.raw
  modified_base (139)..(139): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctntttgtggtggcagcagctacaggtgtccagtcccaggtgcagttggtgcagtctggggctgaggtgaagagctgggtcctcggtgaacggtcccctgcaaggcttcgtggaggctaccttcagcacctatactttcagcgtgggtgaccgacgacggcccctggaccgaagggtctagaggtggagtggggaggactcccgtccgattcgtttaggacaaaccacacctacgcaacacaacgttaaccaggaacacgactacaacgtactaccggacgaacgaactccgaacgacgacaacgagtactaacgagtaggaagagtaggaagtacgaccgtagaagtactacgtagaaccgacgaccgggtaccttagtttactttcggtcggtacggaacgggaaggacgggtacgggggacgtacgggggtccgttagggggttacggttaacgggtttaagggtcgtttcgttttaggacgttacggtcgggttaacggggtaaccggg

SEQ ID NO: 378199 - DNA, 792 bp, Homo sapiens
  misc_feature: GZ8MTXP01CLXYP.38.26.C04.1.454.CMB.2.raw
  modified_base (236)..(236): a, c, t, g, unknown or other
  modified_base (247)..(247): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagctgggtcctggtgaacggtccccngcaggcttcgnggagccaccgttcgctacctatacttcagcgtggtgcgacgacggcccccggagaacgggtcttggacggtggaggtagggggacgggacttccccgtcccggtatttccggtttacgggacccaaaacccacgtaaccgtaaccgacccctaaaccaacgtaacggttaccccgaaacgggaaaccaacggtaacctaccgtaaacccggtaacgttaacccgggaccgggaaaccgaaaccgtacccgaccggaacgaccgtaaccgtaacggttacctaaccgtaggttacggagtaagtaggtaacggtaccggaccgttaggaacggtacttacgtaccggaacggtacccggtaaccgggttcccgttagtttacgtttccgtgggttacggacgggaagggtaacgggggacgggggccgggtacgggggttcggttaccggggttacggggtttaaaccggtttgggttccgtttaacggttttacggtaagtttacgggttcgggttacgggggtaacgttaaacggggtaaccgg

SEQ ID NO: 378200 - DNA, 618 bp, Homo sapiens
  misc_feature: GZ8MTXP01CON1W.38.26.C04.1.454.CMB.2.raw
  modified_base (327)..(327): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagctgggtgcgacaggccccctggacaagggcttggagtggagtgggagggntcccgtccgatctttggacaaacacacctacgcacacagtacccaggaacagacctcacgagtaccgcgacgaactccacgacgcacagtactacagtacggagtacgtaggagtacgccgtaggacgtagtaccgtagaaccgaccgacggtcccggttagttacgtttccgtgggtcggaacggaagggaggggaccgggggccggtacgggggtcgttcgggggttacggttaaccgggtttaagggtcgttcgttttaggacttacggtcggttgggggtaacccgg

SEQ ID NO: 378201 - DNA, 590 bp, Homo sapiens
  misc_feature: GZ8MTXP01B212Z.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctggtgaacggtcccctgcaaggcttcgtggaggctaccttcacgcacctatactttcagtcgtgggtgcgacgacggccccgtggacgaagggcttggaggtggagtggggaggactcccgtccgatcgtttcgacaaaccacacctacgcaacacagtaccagcagactcacgactacgcgacgactcgacgagcacagtactacagtaggagagtagagtacgacgtgagtactacgtacgacgacgtacggtccgttgttattcgtgtgaacggaggacgggacgggggttcggaaggggtcgttacggggttcggttaacgggtttgggtgttcgttttggacgttacgtcgggttcggggtaaccgg

SEQ ID NO: 378202 - DNA, 630 bp, Homo sapiens
  misc_feature: GZ8MTXP01BERSH.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaaggtcccctgcaaggcttcgtggagcaccttcagcacctatactttcagctgggtgcgacgacggcccctggacgaagggcttggagtggagtggggaggctcccgtcccgtattcgttcggaccaaaccacaaccctacgacaacgacaacgtaccaaggcagacctacgaacgtacgttacccggacggtaaacgaactccgaacgacgaccgaacacgtactacgagtcggaagatgaagttacgccgtaggaagtactacgtcgaaccgaccgacggccgttagttactttcgtcggtggaacggaaggacggggacggggcgaacgggggtcgttacggggttggttaacgggttaaggtcgttgttttaggagttacgtcgggttcggggaaccgg

SEQ ID NO: 378203 - DNA, 597 bp, Homo sapiens
  misc_feature: GZ8MTXP01BHY45.38.26.C04.1.454.CMB.2.raw
  modified_base (278)..(278): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcaacacaagttccaggacagactcacgattaccgcgacgaatccacgagcacagtctacatgganatgagtagcctgagatctgacgacacggctgtattctgtgcgaggaggacggggcaggggctcgggtggtaacgttggtgtcttttgaattagtcgtggggtacaaaggggacaagtcgggtacaccgtctactcacgcctccacgaacggcccagtccggtccttcccctggaccacccctcctacaacgacgcctacctcggtcggggccacgcggcccggccgtgggctcggtccgttcggacgaaacggtacttacccgttaccgacggttacgaactacgaacgttcggaacggcgggaacgttcgggaaccgg

SEQ ID NO: 378204 - DNA, 643 bp, Homo sapiens
  misc_feature: GZ8MTXP01EZK7X.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttcgtggagcaccttcagcacctatacttcagctggtgcgacacggcccctggacgaggcttgagtggagtggggaggtactcccgtccgagttcgtttacggaccaaaccacgaccctacggacaacgacaacgttacccgaaggaacacgactaccacgtaacgttaccggacggtaacgaactccacgacgcaacgacgtactaacgagtcggagataggagtacgccgtagaagtactcgtagaccgacgacggtccgtagttcgtttcgtcgtgaaccggaggaggggtacgggggccggtaacgggggtcgttacggggttcgggttaaccggtttaagggtggtttaaccgttttagggacgttacggtaaccggttcgggggtaaacccggg

SEQ ID NO: 378205 - DNA, 609 bp, Homo sapiens
  misc_feature: GZ8MTXP01CTU17.38.26.C04.1.454.CMB.2.raw
  modified_base (455)..(455): a, c, t, g, unknown or other
  modified_base (512)..(512): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctcggtgaacggtcccctgcgaaggtcttcgtgggaggctaccttcagctacctatacttcagcgtgggtgacgacgacggcccctggaaccaagggtcttgagtggagtgggaggctccgtccgattcgttacgacaaaccacaaccctacgacaacaactaacgtacaagaacacgactacacgacgtaccgacgaacgactccgaagacgtcaactacgtactaacgagtagganatggagtacgcggtagagtatacgagaaccgtacgcggtaccgttgttacgtttcgnggtcgaacggagggagggacggggcgtaaggggtccgttagggttaggttacggttaaggtcgttcgtttagagttcgttaacgggcgggtaaccgg

SEQ ID NO: 378206 - DNA, 632 bp, Homo sapiens
  misc_feature: GZ8MTXP01CMLNP.38.26.C04.1.454.CMB.2.raw
  modified_base (443)..(443): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttcgtggaggcaccttcagcactatacttcagctggtgcgacacggcccctggacaagggcttgaggtggagtggggaggtactcccgtcccgagttcgtttacggaccaaaccacaccctacgacactacaagttccaaggaacagacctacacgactaccggacgaacaactccacgagacaacagtctacagtggaanagcggagtacgccgtgaagtagtacgtgaaccgaaccacgaacgtcccggttagttaactttccgtaggtaacggcggaagggacgggacgggggtaacccgtaagggggttccgttacggggttacgggttaaacggttagggttcgttcggtttttagaacgtttaacggttccgggttaacggggg

SEQ ID NO: 378207 - DNA, 602 bp, Homo sapiens
  misc_feature: GZ8MTXP01DUVHF.38.26.C04.1.454.CMB.2.raw
  modified_base (448)..(448): a, c, t, g, unknown or other
  modified_base (492)..(492): a, c, t, g, unknown or other
  modified_base (503)..(503): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaggcttcgtggaggcaccttcagcaactatacttcagctgggtgcgacacggcccctggacgaagggcttggagtgggagtgggggaggtactcccgtcccgattccgtttacggaccaaaccgacaccctacgacacgacaacgtcccaaggcagactacacgtactaccggacgaacgactaccacgacgacacagtactacagtgganagtagagtacgccgtagagtatcgtagaccgacgacggtacgtnttagtttacgngtcggaagtagggacgggcgggggccgaagggggtcgttacggggttggttaacggtttgggtgttcgttttagacgttagtcggttaaggggtaaccg

SEQ ID NO: 378208 - DNA, 536 bp, Homo sapiens
  misc_feature: GZ8MTXP01CP0GM.38.26.C04.1.454.CMB.2.raw
  modified_base (281)..(281): a, c, t, g, unknown or other
  modified_base (435)..(435): a, c, t, g, unknown or other
  modified_base (469)..(469): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctcggtgaaggtcccctgcaaggcttctggaggcaccttcagcacctatactttcagctgggtncgacaggcccctggacaagggcttgagtggatgggaggatccctccgattctttggcaaacgtcacctacgacacacaagttcccaaggccagacctcacgattaccggcgaacgaatccagacgcacagactacatgagatgagtagctgagntctgacgacgcggaccgtgtattctagcgtgagnggagggggcctaggggcttgggttggttaacggttaaggtgtcgtttgattagtcgttggggtaacg

SEQ ID NO: 378209 - DNA, 637 bp, Homo sapiens
  misc_feature: GZ8MTXP01BBZX1.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagcgtgggtgcgacacggcccctggacaagggcttggaggtggagtggggagggactcccgtcccgattcgtttggacaaaccacacctacgcacacacgtaccagcagactcacgacttaccgcgaacaactcccaacgacgcaacgagtacctacagtgggaagagtaggaacgtacgaccgtagaggtactcgtagaaccgacgaccggtccgttgttacgtttcgtggtggcggtaaggacggggtacggggggcccgtaaggggggtccgttacggggttacggggttaaaccgggttttaaggggttcgttccggtttttaggagtttacggttcgggttaacgggggaacccgg

SEQ ID NO: 378210 - DNA, 658 bp, Homo sapiens
  misc_feature: GZ8MTXP01CQ48O.38.26.C04.1.454.CMB.2.raw
  modified_base (353)..(353): a, c, t, g, unknown or other
  modified_base (433)..(433): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagctgggtctcggtgaacgtcccctgcaaggcttcgtggagcaccttcagcacctatacttcagcgtggtcgcgacgacggccccgtggaacaagggtcttgaggtggagtgggaggactccgtcccgattcgttagacaaacncaccctacgacacacaagtccaagcagactacacgactaccgcgaacgaactccagacgacacgagtactacagtagganagtagaagtacgaccgttagaagtacgtcgtagaaccgacgtacgggtacccgttgttaaccgtttcgttaggtggtcgggtaaaggacgggggtaaccgggggaccggtaacggggggtacccgtttacgggggtttacggggtttaaaaccggttttaagggggtacgtttcggtttttaaggtagttaacgggtttccgggttaacgggggtaaaacccggg

SEQ ID NO: 378211 - DNA, 909 bp, Homo sapiens
  misc_feature: GZ8MTXP01DQ9IP.38.26.C04.1.454.CMB.2.raw
  modified_base (279)..(279): a, c, t, g, unknown or other
  modified_base (337)..(337): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcaacagtctacagtgganatgagtagacctgagtatctaggaaccgacgaaccggccgttaggttaatttttccgnggttacggaccgggaaggaacgggggacgggggggcccgaaggggggtccgttaccgggggtttaaggggttaaaaccgggtttaaggggttggtttaccgttttttaggggaaaactttaagttccggggtacgggggtaaccccgtaaaaaagggggaacctaaaacggttcggggttaccctaaaccccgggttcccgttcccttaccgaaccggaccccttaaccccgaaacccggtaaaacccgggggcccccttaaacggtccccggggttttaccccctttacccccccccgttgggaacccccgtaacccccccgtttaccccgttaaccccgtaaaacggggtaaaccgtaccccgaacccggtttaacccgggtcggggggacccctaaaaccgacccggggtccccggggttccccgtacgggggcccgttccgggtccccggttaggggtttaacccgaaaacgggtaccccggtttaacctttaccccgaggtttacggaacgtttaccccggaaacgttggggaaacggttccgggggtccgttaacggggaacccgg

SEQ ID NO: 378212 - DNA, 728 bp, Homo sapiens
  misc_feature: GZ8MTXP01B7UIB.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcggtgaacggtcccctgcgaaggtcttcgtgggaggcctacccttcacgcctacctattactttcagcgtgggtcgcgacgaccggccccgtaggacgaagggtcttggaggtggagtggggagggtactcccgtccgagttcgttacgaccaaaccacgaaccctaccgacaaccgaacctaacgttacccgaaggtaaccacggtacctaccgaaccggtaacgttaacccggacgggaaaccgtaactacccgaacggacgacctaacgacgttacctaacgagtagggaagtagtaggaacgtacgtccgtaggaagtacttacgacgaacgaccgtacgggtaccgttgttacgtttccgaggttcggaacggaagggttcgggggaacgggggccggaagggggttcgttccgggggttagggtttaaccggtttaaggggtttcgtttaacggttttaggacggtttacggttccggggttaacgggggtaaacccgg

SEQ ID NO: 378213 - DNA, 631 bp, Homo sapiens
  misc_feature: GZ8MTXP01CECQW.38.26.C04.1.454.CMB.2.raw
  modified_base (269)..(269): a, c, t, g, unknown or other
  modified_base (273)..(273): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtccctgcaaggcttcgtggagcacttcagcactatacttcagcnggtncgacacggcccctggacaagggcttggagtggagtggggaggatccgtccgattcgttggacaaaccacactacgccacacagtccaggaacagctcacgactaccgacggacactccacgagcacacgtctaacagtaggatagtagagtacgcctagacggtatcgtagaaccgacgtaccggtccgttagttaactttcgtaggttcggaccggtagggaacggggacgggggccgtaacggggggttccgttaccgggggttagggtttaaaccgggtttggggttacggtttccgtttttaggaagtttacggtccgggttacgggggtaacccggttaaaggggttaaccgg

SEQ ID NO: 378214 - DNA, 683 bp, Homo sapiens
  misc_feature: GZ8MTXP01ECOKT.38.26.C04.1.454.CMB.2.raw
  modified_base (326)..(326): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgattctttggcaaaccacactacgcacacaagttccaggacagactcacgattaccgcgacgaatccagagcacagtcacatggagatgagtagcctagagatcgtgaaccgacgacggtccgttagttatttcgngtggcggaaggagggacgggggccgagggggtcgttacggggttacgggttaacggttaggtgtcttttagaaagttacgtcgggtaggggaccgaaaggggactaaggtcggtctacccgttctcctcgacgaccctaccgaacccgaacgggtcccctacggttccccggtcccttcccccgcggtacccctacccccgtaccgtaccgaaacggtaccgcccgtaaccgtcgggtccgggggcaaccggccggcccgggtccgttcggggcctcggtccgttacgggtaccgaaacggtaccttaccgttacgacgttcgaacgtcgaacgtgggacggcggcgttgggaaccg

SEQ ID NO: 378215 - DNA, 870 bp, Homo sapiens
  misc_feature: GZ8MTXP01AR5QO.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcggtgaacggtcccctgcaaggcttcgtggaggcaccttcagccaccttatactttcagtcgtgggtgacgacgacggcccctaggacgaagggcttagaggtggagtgggacggtctcccgtccgagttccgtttacggacctaaacccgacgtaccccgttaaccggacaaccgtaaccgtaaacggttaccccgaagggtaaccacggtaaaccctaccgaaccggtaaccgttaacccgggacgggtaaacccgtaaacgtacccgaaacggtaaccgacccgtaaaccgtacggttaacccgttaaacgaacgttacggggaaacgttacggtacgggtaaacgggtaccggtaccccgggtttaagggaaacggttaccgttaacgttacgggaaacccggttaccggtaaaccccgggggtccgtttaacgggtttaacgtttttccggtacggggttcgggtaaccgggaaacgggggttaacgggggacccgggggggaccccggttaacggggggggtacccgtttaccggggggtttacggggtttaaaacggggtttcggggtttcgggttaaccggttttttaagggaacggtttaccggttaaccgggggttaacggggggttaaaacccggg

SEQ ID NO: 378216 - DNA, 637 bp, Homo sapiens
  misc_feature: GZ8MTXP01BI216.38.26.C04.1.454.CMB.2.raw
  modified_base (316)..(316): a, c, t, g, unknown or other
  modified_base (327)..(327): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacagtggagatgagtagcctgagatctgacgacacggcgtgtattcngtgcgagaggngggggccaggggctcgggtaggtaacggttaggtgtcgttttgaaattactcggtggggacccaaaggggactaagtcgggtactacccgtctcctcgacgccctacccgaaccgaacgggccctacgtccggtcccttcccccgtcgccgacccccttccgtacccaacgaccgaccgtaccgtccgtcgggggacaccgacgcccggcccgtcgggcctcggccgttacgggtaccaaacgggtacctaacccgttccgaacggttcgtaagtccggtaacgtcgggacgcgggtcgttcgggaacgg

SEQ ID NO: 378217 - DNA, 812 bp, Homo sapiens
  misc_feature: GZ8MTXP01ESOBB.38.26.C04.1.454.CMB.2.raw
  modified_base (287)..(287): a, c, t, g, unknown or other
  modified_base (800)..(800): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttgcaaaccacactacgcacacaagttccaggacagactcacgataccgcgacgaatccagagcacagtctacagtggagatgagtagctgantctagacgacgacggtccgttagttactttcgtggtacggaccggaagggacgggggacggggggtaccgacggggggtccgtaccggggttaggggtttaaaccggtttaggggtgtttaccgttttaggtaaacgttacgttcggggtacgggggtaacccggtaaaggggtacctaaacgggttcgggtaccctacccggttccttcccgtacgaccgggtcccctaacccgaacccggtaacccgggtacccttacggttccccgggttccccttccccccggtgggtaccccctacccccgttacccggttaacccgaaacgggtaaccgtccccgtaaacccgttcccgggggtcgggggacccgaaacccggtccggggccccggggtccccggttcggggggtcccttcccgggtcccgtttacggggaaccgttaaacgggttacccttaccgttacccgttcggttacgaacgttaccggaacgtaggggcggaccggggtcncgggggtaaccg

SEQ ID NO: 378218 - DNA, 667 bp, Homo sapiens
  misc_feature: GZ8MTXP01DMN2H.38.26.C04.1.454.CMB.2.raw
  modified_base (468)..(468): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcggtgaaggtcccctgcaaggcttcgtggaggcaccttcagcacctatacttcagctgggtgcgacgacggccccgtggacaagggcttggagtggagtggggagggtactcccgtcccgattccgtttggacctaaaccgaccaacctaccgacaacgaactaacgttacccgaaggaaccagtaaccctacgaccgtaacgttacccggacgggtaaaccgaaactccgaacgacgacaaccngtacctacagtaggaagactagagtacgcgtagaagtactcgtacgaacgaccgtacgggtacccgttgtaacgtttcgcggccggaacgggaagggacgggacggggggcccgaacgggggtcgttaccggggttgggttaaaccggttgggttgttccgtttttagggattacggtcgggttaacgggggtaaccgg

SEQ ID NO: 378219 - DNA, 637 bp, Homo sapiens
  misc_feature: GZ8MTXP01BEIBD.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggcttcgtggaggcaccttcagcacctatactttcagctgggtgcgacgacggcccctggacaagggcttggagtggagtgggggaggtactcccgtccgtatcgtttacggacctaaaccacacctacgacacactaacgtaccaggaacagactacacgtacgtaccgacgaacgaactcccgacgacgcaactagtactaacgagtacggaagagtaggaagtacgaccgtaggaacgtactacgtacgaaccgaccgtacgggtaccgttagttaacgtttcgtggtggaacggaggaggggacggggcgtaacgggggtcgttacggggttgggttaaccggttaagggtcgttaacgttttggagttacgtcgggttcggggtaaccgg

SEQ ID NO: 378220 - DNA, 547 bp, Homo sapiens
  misc_feature: GZ8MTXP01CWMEC.38.26.C04.1.454.CMB.2.raw
  modified_base (346)..(346): a, c, t, g, unknown or other
  modified_base (465)..(465): a, c, t, g, unknown or other
  modified_base (473)..(473): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctcggtgaaggtcccctgcaaggcttcgtggaggcaccttcagcacctatactttcagctgggtgcgacaggcccctggacaagggcttgagtggatgggagggatcctcccgatctttggacaaaccncacctacgcacacaagttcccaggcagactcacgattaccgcgacgaatccacgagcacagtctacatggagatgagtagccgtagagtaatcgtgaacgacacggccgtgtatttcgngtgcgagngggacggggccgaggggcttcgggttggttaacgttaagggtgttcgttttgattcgtcggttcgggtaaccgg

SEQ ID NO: 378221 - DNA, 619 bp, Homo sapiens
  misc_feature: GZ8MTXP01CRXCO.38.26.C04.1.454.CMB.2.raw
  modified_base (139)..(139): a, c, t, g, unknown or other
  modified_base (526)..(526): a, c, t, g, unknown or other
  modified_base (534)..(534): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctntttgtggtggcagcagctacaggtgtccagtcccaggtgcagttggtgcagtcgtggggctggaggtgaagaagccgtgggtcctcggtgaacggtcccctgcaaggcttcgtggagcaccttcagcacctatacttcagcgtgggtgacgacgacggccccgtggaacgaagggcttaggaggtggagtggggaggtactcccgtcccgattcgttacgaccaaaccacacctacgacaacaacgtaacgttacccaaggaaccaagacctacgaacgtacttacccggacgaaaccaactacccgaacgacgaccaacgacgtaccgtaacagtaggaagtagtgaagttacgcgtagagtatccgagaccgacgtacgacgttntacttcgngtgcgaggagggcgggttcggaggggtccgttgggttcggttaaggttgggtgttcgtttagagttacgtcgggttcgggaacgg

SEQ ID NO: 378222 - DNA, 698 bp, Homo sapiens
  misc_feature: GZ8MTXP01C562U.38.26.C04.1.454.CMB.2.raw
  modified_base (569)..(569): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctggtgaacggtcccctgacaaggtcttcgtggaggcctaccttcagccaccttatactttcagctgggtcgacgaccgacggccccgtggacgaaggggcttggaggtggagtggggaggctcccgtccgattcgttaggaccaaacgacaccctacgacacaacgtaacgttacccgaaggtaacaacgtaacctaccgaacggtacttaaccccgggacggaaaccgaactacccgaacgacgacctaacgaacgtactaacgagtagggaagtaagtcggtaagtaccgcgttaggaagtacttacgacggaaccgaccgtacggtccgttagttactttcggnggtcgggaacggagggacgggggacggggttaccgggtagggggtccgtttacgggggttcgggtttaacgggttgggttcgtttaacggtttaggtacggttacggttcggggttaacggggtaaccg

SEQ ID NO: 378223 - DNA, 573 bp, Homo sapiens
  misc_feature: GZ8MTXP01DRP43.38.26.C04.1.454.CMB.2.raw
  modified_base (425)..(425): a, c, t, g, unknown or other
  modified_base (479)..(479): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctggtgaacggtcccctgcaaggcttcgtggaggcaccttcagcacctatactttcagctgggtgcgacgaggcccctggacaagggcttgagtggagtgggagggatcccgtcccgattcgtttggacaaacacacctacgcacacacgtccagggcagactcacgactaccgacgacaactcacgagcacagtactacatganatgatcgcgtgagatcgtagaccgacgacggtccgttagttatttcgtgtcggngaggagggacgggggcgaacgggggtcgttcggggttggttaaccggttaagggtgttcgttttggagttacgttcggttaacggggtaaccgg

SEQ ID NO: 378224 - DNA, 626 bp, Homo sapiens
  misc_feature: GZ8MTXP01BQP98.38.26.C04.1.454.CMB.2.raw
  modified_base (242)..(242): a, c, t, g, unknown or other
  modified_base (253)..(253): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgagtccctgcagcttcgnggagcaccttnagcactatactttcagctggtgcgacacggcccctggacaaggcttggagtggagtggggaggtactcccgtccgattcgttacggacaaaccacacctacgacacacaacgtacccaggaacacgacctcgacgtacttacccggacggaacgaactccgaacgacgacaacagtactaacagtaggagatagaagtacgaccgtagaacgtatacgtacgaaccgtacgaccggtaccgttagttaactttcgtcggtggaacggaagggacggggacgggggccgagggggtccgttcggggttacgggttaacggtttaagggttggttcgtttttaggagttacggttcgggttaacggggtaaccgg

SEQ ID NO: 378225 - DNA, 573 bp, Homo sapiens
  misc_feature: GZ8MTXP01CAIHD.38.26.C04.1.454.CMB.2.raw
  modified_base (280)..(280): a, c, t, g, unknown or other
  modified_base (435)..(435): a, c, t, g, unknown or other
  modified_base (444)..(444): a, c, t, g, unknown or other
  modified_base (495)..(495): a, c, t, g, unknown or other
  modified_base (547)..(547): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttctggaggcaccttcagcacctatacttcagctgggtncgacacggcccctggacaagggcttaggagtgggagtgggggagggactcccgtcccggattccgtttaggaacaaacccgacacccctacggcacaaccagttacccaggaacagactcacgataccgcgacgaatccagagcacagtacctanagtgggaanatgaagtacgccgtagagattcgagacgacgacggtccgttgtaatttcgngtgcggagagggacggggccgaggggtccgttagggttggttaacgttggtntcgtttgagttgtcgttggggaaccg

SEQ ID NO: 378226 - DNA, 713 bp, Homo sapiens
  misc_feature: GZ8MTXP01DR7K3.38.26.C04.1.454.CMB.2.raw
  modified_base (139)..(139): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctntttgtggtggcagcagctacaggtgtccagtcccaggtgcagttggtgcagtcgtggggctggaggtgaagagccgtgggtcctggtgaacgtccctgcaaggcttcgtggagcaccttcagcacctatacttcagcgtgggtgcgacgcggccccgtggacgaagggcttggaggtggagtggggaggtactcccgtccgtagttcgtttacggaaccaaacccactaacccgtaccgacaacgaacctaacgttacccgaaggaaccgaacgaacccttaccgaaaccgtaacgttaacccgggacgggtaaaccgaaacgtcccgaaacggacgaccaaccgtacgttaaccgtaacgtaagtacgggaacgtaacgttaggaacggtacggtaccgtaggaacgtaacgtaccgtacggaaacccgaccgtaaccgggtaccgtttagttcgtttacgtcggtagggaacggaaggagggggacggggaccggaggggtcgttcggggttacgggttaaacggttgggttgttcgttttaggacgttacggtcgggttaacgggtaacgg

SEQ ID NO: 378227 - DNA, 606 bp, Homo sapiens
  misc_feature: GZ8MTXP01D1DLV.38.26.C04.1.454.CMB.2.raw
  modified_base (430)..(430): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacgacggcccccgtggacaagggtcttggaggtggagtggggagggtactcccgtccgattctttcggacaaaccacacctacgcacacaacgtaccaggaacagacctacaacgacttaccggacgaacgaactccgacganacacagtactacagtaggagatggagtacgccgtagagtactacgaggaccgacgtaccggtcgttgttattcgtggtggaacggaggaggggacgggggcgtacgggggtcgttacgggttgggttaaccggtttggtgttcgttttagagttacgttcgggttcgggtaaccgg

SEQ ID NO: 378228 - DNA, 660 bp, Homo sapiens
  misc_feature: GZ8MTXP01EK4XR.38.26.C04.1.454.CMB.2.raw
  modified_base (472)..(472): a, c, t, g, unknown or other
  modified_base (531)..(531): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcggtgaacggtcccctgcaaggtcttcgtggaggcaccttcagcacctatactttcagctgggtgcgacacggccccctggacgagggcttggaggtggagtggggagggtactcccgttcccgtattcgtttacggaccaaacccgactaaccccgtaccgacaaccacgtaacgttacccaaggcacgacctacacgtacgttaccgacggtaacactccgagacgacacgagtactacagtagganagtgagtacgccgtagacgtatcgacggacgaccgacgggtccgttagtacgtttccgnggccggaacggtaagggacggggacgggggaccgaagggggtccgttacgggggttacgggtttaaccgggtttaagggttcgttcggtttttaggagttacggttcgggttaacgggggtaaaccggg

SEQ ID NO: 378229 - DNA, 644 bp, Homo sapiens
  misc_feature: GZ8MTXP01CXQ66.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagagctgggtcctggtgaacgtcccctgcagcttcgtggaggcaccttcagcacctatactttcagcgtggtcgacgacgacggcccctaggacgaagggtcttggagtggagtaggggacggctcccgtccgattcgttcggaaccaaaccacgtacctacgacacaactaacgtccgaaggtaacacgactacgacgtacgttaccgacggaaacgaactaccgaacgacgacaaccgtaacgtactaacagtacgggaagtaatacgggtaaacgttacgccggttaaggacgtagtacgtacgaacgtaccgacggtacgttcgtagtttcgcggacgcggaggacggggacggggcgtaacggggtccgttaggggttcgggttaacggttggtagttcgttttaggacgtttacggcggttaacgggaacg

SEQ ID NO: 378230 - DNA, 610 bp, Homo sapiens
  misc_feature: GZ8MTXP01DS18O.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccagagcacagtctacatggagatgagtagctgagatctagacgacgacggccgtgtatttctgtgcgagaggagggggccaggggctcggtacggtaacggttaggtgtcttttagaattagtcggtaggggaccaaaggggtacaagtcgggtaccacccgtctcctcgacgccctaccaccgaacggccctacgtccggtcccttcccccgtggcccaccccgtcctaccgaacgcgaccgaccgtcgcggggcaaccgcggcccgccgtcgggcctcggccgttcggtaccgaaacggtacccttaccttcccgacgttcgaacgtcgaacgtggacgcggcgttcggaacg

SEQ ID NO: 378231 - DNA, 724 bp, Homo sapiens
  misc_feature: GZ8MTXP01B1CWM.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctcggtgaacggtcccctgcaaggtcttcgtgggacggctaccttcagcctaccttatacctttcgagtcgtgggtcgaccgtacgaccgggccccctagggaccgaagggtcttaggaggtggagtacgggggaggacttcccgtcccgtagttccgttacggaaccaaaccgcctacccgtaaccggctaaccaacgtaacgtaacccgaaggtaaccagaaccctacgaaccgtacgttaacccgggacggaaacaactacgaacggaacgacaacgacgttactaacgagttaggacgtagtagaagtacgccgtaggagtataccgtacgaccgaccggacggtaccgtgttacgttcgaggcggaacggaaggacggggacgggggttcggtaacgggggtccgttacgggggttccgggttaaagggttttccggggttacgttaaccgtttttaggacggttacggttaaccggggttaacgggggtaaacccgg

SEQ ID NO: 378232 - DNA, 558 bp, Homo sapiens
  misc_feature: GZ8MTXP01AON04.38.26.C04.1.454.CMB.2.raw
  modified_base (206)..(206): a, c, t, g, unknown or other
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccncactacgcacacaagttccaggacagactcacgattaccgcggacgaatccacgagcacagtctacatggagatgagtagcctgagatctgacgacacggccgtgtatttcngtgcgagagagggggccaggggctcggtggtaacgttaggtgtcttttgaattagtcgtggggaccaagggacaagtggtcacccgtctcctcacgcctccaccaacgggcccatcggtccttccccgtggccacccctccgtccaacgcgccacctcgtcggggcacgacgtccggcccgtgggctgccgttggtcaaggactacttccgacgttcgaatcgaactgagcggcgttgcg

SEQ ID NO: 378233 - DNA, 617 bp, Homo sapiens
  misc_feature: GZ8MTXP01E0PXV.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaccacactacgcacacaagttccaggacagactcacgattaccgcgacgaatccacgagcacagtctacatggagatgagtagcctagagatcgtgacgacgacggccgtgtatttcngtgcgagaggagggggccagggggctcgggtggtaacggttaggtgtctttgaattagtcggtggggaccaaaggggacaagtcggtacaccgtctcctctacgcctaccgaccgaacgggccctagtcccggttcccttcccccgtggcccctacccctccgtaccgaacggacgaccctaccgtcggtcgggggacaccggacgtccgggtcccgtcgggctcggtccgttcggtacgaacgggtacctaccgttccgcgttgaactcgaacgtcgggacgcgggtcgttggaaccg

SEQ ID NO: 378234 - DNA, 605 bp, Homo sapiens
  misc_feature: GZ8MTXP01EB9OT.38.26.C04.1.454.CMB.2.raw
tcagtcgatcacgtcacgaccggtgctcgatttagtctagcgactttgggttttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgccaagggcttctggaggcacctttcagcacctatactttcagctgggtgcgacaggccccctggacaaagggcttgagtggatgggaggatcccgtcccggatctttggacaaaccgcacctacgcacacaagttcccagcagacctcacgattaccgcgacgaatccacgagcaccagtacacatggagatgaagttacgccgttagagaattcgagacgacgacggacccgttgtaagtttctgttgaacggaggagggaacgggggcccgaagggggtcccgttacggggttggggttaaaccggtttaaggggttaggttccgtttttagggactttaggttccggtttgggggtaaccccgg

SEQ ID NO: 378235 - DNA, 657 bp, Homo sapiens
  misc_feature: GZ8MTXP01CXUQK.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtccccctgcaaggcttcgtggaggcacccttcagcacctatactttcagctgggtgcgacacggccccctggacaagggcttggagtggagtggggagggatccctccgattcttggacaaaccacacctaccgcacacaagttcccaggaacagactcgacgtactaccgcgacgaatcccgaacgagacacagtaccttaacgagtacgggagagtaggaagtacgtccgtaggaaaggtacttaccgtagaaccggaccgtaccgggtaccgttggttaattccgtggtacgggaacggaagggacggggaagggggccccgtaaaggggggtcccttaccgggggttggtttaaaaccgggtttgggggttacgttccggttttttaggacggtttacggttccgggttaagggggtaaacccgg

SEQ ID NO: 378236 - DNA, 574 bp, Homo sapiens
  misc_feature: GZ8MTXP01A7PE0.38.26.C04.1.454.CMB.2.raw
  modified_base (431)..(431): a, c, t, g, unknown or other
  modified_base (486)..(486): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgccagtctggggctgaggtgaagagcctgggtcctcggtgaaggtcccctgcaaggcttcgtggaggcaccttcagcacctatactttcagtctgggtgcgacacggcccctggacaagggcttggagtggagtgggagggatccctcccgatcgtttggacaaaccacacctacgcacacaagtcccaggcagactcacgtattaccgacgacgaactccacgagacacagtactacagtgganatggagtacgcgtagagtatctacggacgtacgaccggtaccgtgttactttcgnggcgaaggaggagggcggggcggacggggtcgttacgggttgggttacggttggtgttcgtttaggagttacgtcggttcgggtaacg

SEQ ID NO: 378237 - DNA, 767 bp, Homo sapiens
  misc_feature: GZ8MTXP01A0DFM.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagcctgggtcctggtgaacggtcccctgacaaggtcttcgtggacggctaccttcacgcctactatactttcagtcgtgggtcgcgacgacggccccctaggacgaaggggtccttaggagtgggagtacgggggacggtactcccgtacccgtagttccgtttacggaccaaaaccacgtaaccccgtacggacctaaccaaccgtaaacgttaccccgaaagggaaccaaggtaaaccttacccgaaaccggtaacgttaccccgggacggaaaccgaaaccgttacccgaacggacgtacaaccgtacggttaacccacgtaagtacgggaagaacgttaggaacgttaaccggacccggaaggtacttacgacgaacggacccgacggtcccgtagtttattccgtagttcggcgggaaggacggggacggggacccggttagggggtaccgttacgggggttaagggttaaaccggttaggggttccggtttcggtttaacggtaggtttaacggttccggggttaacgggggaaccccggtaaaaggggg

SEQ ID NO: 378238 - DNA, 579 bp, Homo sapiens
  misc_feature: GZ8MTXP01DJS27.38.26.C04.1.454.CMB.2.raw
  modified_base (423)..(423): a, c, t, g, unknown or other
  modified_base (485)..(485): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggaggatccctcccgatctttggacaaaccacacctacgcacacaagttcccaaggcagactacacgattaccgcggacgaatccacgagcacagtactacatgganatgagttacgccgttaggagtaactcgtagaccgacgaccggtcccgttgttaattttccgnggttcgcggaaggagggacgggggcccgaagggggtcttacggggttggttaaccggttaaggtgtcgttttgattagtcggttcggggaaccg

SEQ ID NO: 378239 - DNA, 718 bp, Homo sapiens
  misc_feature: GZ8MTXP01B86L1.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctcggtgaacggtcccctgcaaggtcttcgtggaggcaccttcagccactatacttcagctgggtgcgacgcggcccctggacgaagggcttggagtggagtgggggacggtactcccgtcccgattccgtttacggaccaaaccacacccgtaccggcaacaaccgtaagttcccgaaggtaaccacggaacctaccaacgtaacgttacccggacggaaaccgaactacccacgacgacaacacggtacctaacgagttagggaatagtaggaacgtacggcccggttaggaacgtacgtacgtacggaaccgaaccgtaaccgggttccgttagttaacttttccggtggttagggaaccgggtaagggacgggggtaccggggggacccgtaaggggggttcgttaccgggggttagggttaaccggggtttaaggggtcgtttaaccggttttaggacgttacgggtaaccgggttaacgggggaaacccggg

SEQ ID NO: 378240 - DNA, 585 bp, Homo sapiens
  misc_feature: GZ8MTXP01AM460.38.26.C04.1.454.CMB.2.raw
  modified_base (315)..(315): a, c, t, g, unknown or other
  modified_base (475)..(475): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagccgtgggtcctcggtgaacggtcccctgcaaggtcttgtggaggcaccttcagcacctatactttcagcgtgggtgcgacgacggcccctggacaagggcttagngtggagtggggaggactccctccgattcgttcggacaaaccacacctacgcacactaacgttaccaaggaacagactacacgacgttaccgacggacaactaccacgacgctacagtctacagtggaagatagagtagccgtagagaatcgtagacgacncggaccgtgtacttgtagtgaacgaggagggacggggccggaggggtcgttcggggttcggttaacgggtttgggcgttcgtttgagttacgtcggttcgggtaaccggg

SEQ ID NO: 378241 - DNA, 612 bp, Homo sapiens
  misc_feature: GZ8MTXP01CQPGZ.38.26.C04.1.454.CMB.2.raw
  modified_base (276)..(276): a, c, t, g, unknown or other
  modified_base (320)..(320): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacaatccacgagcacagtctacatgganatgagtagcctgagatctagacgacgaccggtccgtgtatttcnggtgacgaggaggagggggccgaggggctcgggtaggtaacggtttaggtgtcttttagaagttactcggtaggggacccgaaaggggactaagtcgggtaccacccgtctccgtcacgccctaccgaaccgaacgggcccacgtccggttccctccccgtcggccctaccctccctacctaaacgacgccacccgtcgtcggggccacgacgccgccgtcggctcgcgttggtaccgaggtacctcttccgacgttcgaagtccgaacgtcggacggcggcgttcggaacg

SEQ ID NO: 378242 - DNA, 622 bp, Homo sapiens
  misc_feature: GZ8MTXP01C1F8P.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacaactccacgagcaacagtctacatggagatgagtagcctgagatctgacgacgacggcgtgtactttctgtgcgaggagggagggggtccagggggtctcgggtacggtaacggttggtgtcttttgaattagtcgtggggaccaagggacaagtcggtcaccgtctctcgacgccctaccgaccgaacgggccctacgtccggtcccttcccccgtggacccctaccccgtcctacccgaacgtacgcccgaacccgtccggtcgggggccaaccggcgcccgggcccgtcggggcctcggccgttcgggtacaacggtaccttacgttccgcgttgaacgtacggcgtggacggttcggcgttggaacg

SEQ ID NO: 378243 - DNA, 711 bp, Homo sapiens
  misc_feature: GZ8MTXP01AJ8V7.38.26.C04.1.454.CMB.2.raw
  modified_base (368)..(368): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctcggtgaacggtcccctgacaaggcttcgtggaggctaccttcagctacctatactttcagcgtgggtgcgacgacggcccctggactagggcttaggagtggagtggggacggtactcccccgtccgtattcgttagaccaaaccncacccgtacgacacactaacgttccgaaggtaacacgacctacaaccgtacgttaacccggacggaaccgaactcccgaacggacgaccaacgtacgtaccgtaacgagtgggaaagtacgttagaacgttaacgacccggtagggactacgttacgtaacggaaccgaccggtaccgggtccgtttagtttacgttccgttaggcgggaacggaaggggaccgggggacggggttacccggtagggggttaccgttacgggggtttaacgggttaaggggtttcggttccgtttaacggttttaggaacgtttacgggtcgggttaacgggggtaaacccgg

SEQ ID NO: 378244 - DNA, 618 bp, Homo sapiens
  misc_feature: GZ8MTXP01AYAGK.38.26.C04.1.454.CMB.2.raw
  modified_base (246)..(246): a, c, t, g, unknown or other
  modified_base (334)..(334): a, c, t, g, unknown or other
  modified_base (466)..(466): a, c, t, g, unknown or other
  modified_base (497)..(497): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagccgtgggtctcggtgaaggtcccctgcagtcttcgnggaggcactcagcactatacttcagcgtggtgcgacgacggcccctggacgaagggcttggagtggatggggagggatcccgtaccgngtcgtttggaccaaacacacctacgacacacgaacgttccgaagcacgactacaccgagttacccggacgacaactccgacgacgccacgagtactacgagtacggagtagtagagtacgacgtagagtacncgtagaccgacgacgtccgtgtacgtttcgnggccgtaaggacggacgggtacgggggccgtaagggggtccttacgggggttaggttaaccgggtttaagggtcgttaacgtttttggaacgttacgtaacgggttcggggtaaacccggg

SEQ ID NO: 378245 - DNA, 809 bp, Homo sapiens
  misc_feature: GZ8MTXP01C66J1.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgcctcctcccgatctttggacaaaccacactacgcacacaagttccaggacagactcacgattaccgcgacgaactccagagcacagtctacatggagatgagtagcctgagatctgacgacacggtcctgttatttctggtggcggaaggagggacgggggccagggggtcgtacgggtacgggttaacggttaggtgtcgttttagaattagtcggtacgggggtaacccgaaaggggtaacaaacggttcgggtacctacccggttccttacccgtacgtaaccgtccccgtaccccgaaacccggaaaccgggggtccccccttaacggtttccccggggttccccctttcccccccgtccgggtaccccttacccccccgttaccggtaaccccgaaacggacccgtacccgtaacccgttccgggtaccggggggacccaaacccgggccggggtccccgggccccggttcgggggtcccttaaccggggtaccccggttacggggttaacccgaaaccggggttaaccctttaacccgttttaccccgacgggtttaccggaaccgtttaccgggcgttacgggggacggggttcccggggtcggttaacgggtaaccggg

SEQ ID NO: 378246 - DNA, 757 bp, Homo sapiens
  misc_feature: GZ8MTXP01BB38L.38.26.C04.1.454.CMB.2.raw
  modified_base (277)..(277): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcgacgaatccacgagcacagtctacgatggantagagtacgctagagatcgtagacgacgacggtccgtagttactttctggtcgcggaaggtacgggacggggggccgtaagggggtcgttacggggttacgggttaacggtttagggtcgttcgttttaggaattacgttcggtggggaacccgtaaagggactaagtcgggtacctacccgtcctccgtacgaccgcccgtacccaaccgaacgggtcccctacgttcccgggtccccttaccccgcggaccctaccccgttccgaactaacggacgtcccgtaaccgtccgggtacgggggacccaaccggccggtccccgggtccccggtcggggtcccgttcgggtccccgttacggggtaccgttaaaccgggtacccgtttaaacccgttccccggttaacggttacggtaacccggtacccggtaaccgttcggggacgggttccccggggtaacgttaaccgggaacccggg

SEQ ID NO: 378247 - DNA, 692 bp, Homo sapiens
  misc_feature: GZ8MTXP01BK4Z3.38.26.C04.1.454.CMB.2.raw
  modified_base (276)..(276): a, c, t, g, unknown or other
  modified_base (316)..(316): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccagagcacagtctacatgganatgagtagctgagatctgacgacgacggccgtgtatttcnggtgcgaggaggacgggggcaggggctcgggtacggttaacgttaggtgtcttttgaagttagtcgtacggggaccaaaggggacctaaagtcgggttaccacccgttccgtaccgtcacgtccctacccgacccgtaaaccgggccctaacgtcccggttcccgttacccccgtcgggtacccctaccccgttacccgttacccgaaacggaccgtacccgtacccgtccggtacggggggcccaaaccggtccggcccgggtccccggtcggggtccgtccggccgttacggtaccgttaaacgggtaccttaaccgttcccgttaccgttgtaacgtcgtaacgtcggacggcgggtcgttaacgggaaccgg

SEQ ID NO: 378248 - DNA, 641 bp, Homo sapiens
  misc_feature: GZ8MTXP01CVJWO.38.26.C04.1.454.CMB.2.raw
  modified_base (475)..(475): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtctcggtgaaggtcccctgcaaggcttctggaggcaccttcagcacctatactttcagctggtgcgacacggcccctggacaagggcttggagtggagtggggacggactcccgtccgagttcgttacggaaccaaaccgacacccgtacgacactaacgtaaacgtaccgaacggaaccaaggacctacgaaccgtagtaacccggacggaaacgtaacaccgaacgacgacactaacgtactacagtaggagaagngaagtaggactagagtatacgtacgaaccgaacgtacggtaccgttgttaacgtttcgcggtggaacggagggacggggaccgggggacggtacggggtcggttacggggttagggttaacggttggtgtttcgtttaggtacgttacggtcgggaacgggtaacg

SEQ ID NO: 378249 - DNA, 655 bp, Homo sapiens
  misc_feature: GZ8MTXP01CQ3P0.38.26.C04.1.454.CMB.2.raw
  modified_base (244)..(244): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagctgggtcctggtgaacggtccctgcaaggcttcgnggaggcaccttcagcacctatactttcagtcgtgggtcgcgacgacggcccccgtaggacgaaagggcgttagaggtgggagtgggggacggattccccgtcccgagttccgtttaggaccaaaccacacctaccgacacacaacgttacccgaggaacagaacctcaacgtacgttacgacggaaaccgaatcccgaacgagccaacgacgtactaacgagtagggaacgtataggacgtaaacgccggttagaaggttacctacgtacggaacccgtacgtaccgggtccgttacggttaactttccgtaggttgaacggtaggaggggacggggcggacggggtcgttcgggttggttaacggtttgggtagttcgttttaggacgtttacgtcggttcgggaaccgg

SEQ ID NO: 378250 - DNA, 649 bp, Homo sapiens
  misc_feature: GZ8MTXP01DBFQS.38.26.C04.1.454.CMB.2.raw
  modified_base (332)..(332): a, c, t, g, unknown or other
  modified_base (627)..(627): a, c, t, g, unknown or other
  modified_base (630)..(630): a, c, t, g, unknown or other
tcagtcgatcacgtcacgaccggtgctcgatttagtctagcgactttgggtttggggagtggttttcttcgatgggggcgtgggagggctttgttggagaccttgcacttgtactccttgccattcagccagtcctggtgcaggacggtgaggacgctgaccacacggtacgtgctgttgtactgctcctcccgatctttggcaaaaccacactacgcacacaaagttccaggacagactcacgattaccgcgacgaatccacgagcacagtctacatggagatgagtacgcctgagatctaggacgacgtacggccgttgtacttttcggnggtagacggaaggaggggacgggggtccgagggggtcgttacggggttacggttaacggtttggttgttcgttttagaattaccgtcggtacggggaaaccgtaaagggactaaggtcggtccacccgtctccacacgtccctaccgaaccgaccggtcccgtacgtccccgttccctccccgtcgcccctaaccccgtccgtaccgaacgaccgaccgtacccgtcggtcgggaccacgcggcccggtccgcggtcgtcgcgttcgaacgaacgtctaccgttcgcgttgaacncgngcggcggcggtcgaacgcg

SEQ ID NO: 378251 - DNA, 625 bp, Homo sapiens
  misc_feature: GZ8MTXP01B80ZJ.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagccacctatacttcagctgggtgcgacacggccccctggacgaagggtcttggaggtggagtgggggacggtactcccgtcccgattccgtttaggaccaaacccacaaccctaccgacaacgacaacgtacccaaggaacagacctacacgtactaccgcgaacactccgacgacgcaacacgtactaacagtaggagagtaggaagtacgccgtaggtagtactcgtaggaaccgaccgaccggtccgttagttactttcgtggtgaacggaggacgggagggggccgagggggtcgttacggggttggttaacggtttgggtcgttcgttttaggagttacgtcgggttcgggtaaccgg

SEQ ID NO: 378252 - DNA, 614 bp, Homo sapiens
  misc_feature: GZ8MTXP01C6EBT.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaagtcccctgcaagcttcgtggaggcaccttcagcactatactttcagcgtggtgcgacacggccccgtggacaagggcttgagtggagtggggagggactcccgtcccgattcgtttggacaaaccacaccctacgacacacaacgtcccaagcagactcacgacttaccgacggacgaactcccgacgagcacgacgtactacagtcggagagtaggagtacgaccgtggaagtactcgtacgaaccgacgaccgggtccgttgttactttcgtaggtcggaacggaagggaggggacgggggcccggtaagggggtcgttacggggttcgggtttaacggtttaagggttgttcgttttggagtttacgtcggttcggggtaaccgg

SEQ ID NO: 378253 - DNA, 612 bp, Homo sapiens
  misc_feature: GZ8MTXP01CB15L.38.26.C04.1.454.CMB.2.raw
  modified_base (452)..(452): a, c, t, g, unknown or other
  modified_base (511)..(511): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctgggtcctggtgaaggtcccctgcaaggcttcgtggagcaccttcagcactatactttcagtctgggtgcgacacggcccctggacaagggcttggagtggatgggggagggtatcccgtcccggattcgtttcggacaaaccgcacctacgacacaactacgtaaccaggaacagactaccacgaacttaccggacgacgaactccaacgacgacaacgagtactaacagtgggaanagtagtagtacgacggtagacgtatacgacgacgacgtacggtcgttgttacttcgtgnggaacggagggacggggacggggcggtaggggtcgttacggggttcgggttaacggttgggttcgttcgtttaggacgttacggtcgggttcgggtaaccg

SEQ ID NO: 378254 - DNA, 611 bp, Homo sapiens
  misc_feature: GZ8MTXP01EFU8L.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgacgatctgacgacgacggccgtgtatttctgtgcgaggaggagggggccaggggctcggtcggtaacgttaggtgtcttttgaattatcggtggggaccgaaagggactaagtggtctaccgtctcctcacgcctccaccgaacgggccagtccggtccttcccccgtgccctacccctccgtacccaagacgccaccgtcgtggggaccacgacggccggcccgtcgggctcggccgttgggtaccgaaacggtaccgtaaccgttcccgcgttcgaacgttaccggaacgtcgggacggccgggtcgttcgggaaccgg

SEQ ID NO: 378255 - DNA, 606 bp, Homo sapiens
  misc_feature: GZ8MTXP01EKRCY.38.26.C04.1.454.CMB.2.raw
  modified_base (318)..(318): a, c, t, g, unknown or other
  modified_base (329)..(329): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggngggggcaggggctcggtgtaacggttaggtgtctttgaatagtcgtggggaccaagggacaagttcgggactaccgtctcctcgacgcctccaccgaacgggccctacgtccggtcccttccccctcggaccaccccttccgtaccgaacgacgccgacccgtcggtcggggccaacgcggcccggtcccgtcgggcctcggtccgttacggtacgttaaacgggaccttacgttaccgcgttgaacgttcgaacgtggacggcggcgttggaaccg

SEQ ID NO: 378256 - DNA, 691 bp, Homo sapiens
  misc_feature: GZ8MTXP01ALSZ1.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgtccaaggtcttcgtggaggcaccttcagcacctatacttcagctgggtgcgacacggcccctggacaagggtcttaggacgtggagtggggaggtactcccgtccgtattcgttacggacctaaaccactaccctacgacacgaactaagttacccaggtaacagacctacgacgtactaccggacgtaacgaactaccgacgacgacaacgagtactacgagtggaagtacgtagaacgttacgaccggttaggacggtaatacgtacgaaccgtacgaccggtaccgttagttacgtttcgtacggttcgggaacggaacgggagggggaccgggggacccgtaaggggggtaccgttacgggggtttaacgggttaaaccgggtttaaggggtttcgttccggttttttaggacgtttacggttaacgggttaacgggggtaaacccggg

SEQ ID NO: 378257 - DNA, 655 bp, Homo sapiens
  misc_feature: GZ8MTXP01BPBQQ.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagcctgggtcctcggtgaacggtcccctgcaaggcttcgtgggaggcaccttcagcactatactttcagctgggtgcgacgacggcccctggacgaagggcttggaggtggagtggggacggtactcccgtccgattctttacggaccaaaccacaccctacgcacaacaacgttaccaaggaacacgactacaccgtacttacccggcggaaacgaactacaaacgacgacaaccagtactaacagtaggagatagagtacgcgtagacgtatcgtagaccgacgacggtaccgttgttactttcgcggcggaacggaagggacggggacggggggttacccgaaggggggtccgttacgggggttacgggttaaacgggtttaacggggttcggttaacgtttttaggaagtttacggttccgggttaagggggtaacccgg

SEQ ID NO: 378258 - DNA, 609 bp, Homo sapiens
  misc_feature: GZ8MTXP01DQDI6.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagcgtgggtgcgacaggccccctggacaagggcttgagtggatgggaggatccctccgatctttggacaaaccacaaccctacgcaacaacaaacgttcccaggaacagacctacaacgattaacccgcggaacgaaactccaacggagacaacagtactaacagtaggaagatagaagtaaggccttagaagtatcaggaaccgacgaacggtccgttagttaatttccgtgtggaaggaaggaggggacgggggacccgagggggtccgttagggggttacggttaacgggttaagggtgttcgttttgattagtcggttcgggggaaaccgg

SEQ ID NO: 378259 - DNA, 638 bp, Homo sapiens
  misc_feature: GZ8MTXP01EX2VF.38.26.C04.1.454.CMB.2.raw
  modified_base (596)..(596): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacgaggccccctggacaagggcttggagtggagtggggagggtatcccgtcccgtattcgtttaggacctaaacccacaccctacgacaacaactaacgttacccaagggaacaaggactaccacgtacttacccggcggaacgaactcccgaacgacgacacagtactacgatgggaatatacggaagttacgccgtagaagtacttcgacgacgacgaccggtccgttgttaactttcgcgtacggcgagggagggacgggggccgagggggtccgttacgggttcggggttaaacggtttaagggnggtttcgttttggagttacgtcgggttaacggggaaaccggg

SEQ ID NO: 378260 - DNA, 663 bp, Homo sapiens
  misc_feature: GZ8MTXP01EKJ56.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagccgtgggtcctcggtgaacggtcccctgcaaggtcttcgtgggaggcctaccttcagcacctatactttcagcgtgggtgcgacgacggcccccgtggacgaagggtcttggaggtggaggtggggagggtactcccgtacccgtattcgtttacggacctaaaacccgaccaacccgtaccgacaaccgaacgtaacgttaacccgaaggaaccaagacctaccgaaccgtacgttaacccggacggaaccgaaactcccgaacgacgacaacgtagtacctaacagtagaagatagagttacgaccgttaggacgtagtacgtagaccgacgacggtccgttgttatttcgtcgtggcggaagggagggacgggggttccggaggggtcgttacggggttggttaacgggttggttgttgtttagagttacgtcggttcggggaaccg

SEQ ID NO: 378261 - DNA, 708 bp, Homo sapiens
  misc_feature: GZ8MTXP01AJFC7.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagagcctgggtcctggtgaacggtcccctgcaaggcttcgtggacggcaccttcagcacctatactttcagcgtgggtgcgacacggcccccgtaggaaccgaggtcgtaggaggtaggtaggtagggggacggtctcccgtaccgtagttcgttacgaaccaaaccacctaacccgtaccgacaactaaccgtaacgtaaccgaacggtaaccgacgtaaccctacgtaaccgtaacgtaaccggacggtaacgaaccaccgaacgacgacacgacgtactacgagtaggaagacgtagagtacgacggtagacgtcgtacgacgaccgtacgaccggttacgtcgtttacgttcggacgcgggaacggaacggggacgggggaccggggccgggtacgggggttaccggttacggggtttacggggttaaacggtttggggttccgtttaacgttttaaggacgtttacggttccggggttaacggggtaaaacccggg

SEQ ID NO: 378262 - DNA, 613 bp, Homo sapiens
  misc_feature: GZ8MTXP01EF5V5.38.26.C04.1.454.CMB.2.raw
  modified_base (277)..(277): a, c, t, g, unknown or other
  modified_base (324)..(324): a, c, t, g, unknown or other
  modified_base (453)..(453): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatgganatgagtagcctgagatctgacgacacggtcgtgtattctgtgcgagnggagggggccaggggctcggtggtaacggttgtgtctttgaattagtcggtaggggaccaaagggacaagtcgggtcaccgtctcctcacgcctccgaccgaacgggcccagtccgtcccttcccccgnggacccacccctccgtaccgaagtacgccgaccgttcgcgggggaccacgacggccgggcccgtcgggcctcggcccgttgggtaccgttaacgggtaccttacgttacccgcggttcgaacgttccgaacgttcggacggcgggtaacgttggaaccgg

SEQ ID NO: 378263 - DNA, 621 bp, Homo sapiens
  misc_feature: GZ8MTXP01AFOEE.38.26.C04.1.454.CMB.2.raw
  modified_base (326)..(326): a, c, t, g, unknown or other
  modified_base (614)..(614): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatcgtggaacgacgacggtccgtgttactttcgngtgcggaggagggacgggggcgagggggctcggggtaggttaacggttaggtgtctttgaattagtcggaggggaccgaaagggactaagtcggctaccgtctcctcacgtcctaccaccgaacggccctacgtccgtccccttcccccgcggaccctacccctcccgtaccgaacgtaccgaccgacccgtccggcgggggccaacgcggccggcccgtcgggcgtcgccgttggaccacggtacctaccttcgcgttcgcgtacgtaacgtcgggacggcggtcgnggaacgg

SEQ ID NO: 378264 - DNA, 669 bp, Homo sapiens
  misc_feature: GZ8MTXP01CA3L4.38.26.C04.1.454.CMB.2.raw
  modified_base (645)..(645): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagccgtgggtcctcggtgaacggtcccctgacaaggtcttcgtgggagctaccttcagcacctatacttcagcgtgggtgcgacgacggcccctaggacgaagggcttaggagtggagtggggacggtactcccgtccgtattcgtttacggaccaaaccgctaacccgtaccgactaacgaactaacgttacccgaagggaaccagtaacctcgaacgtacgttaacccgggacgggtaaacaactaccgaacggacgacaaccgtagtaccctaagagtcggagtagtaggacgtacgaccgtaggaacgtcgttacgaggaccgaaccgcggttaccgtgtttacgttcgtgtggaacggtaggacgggggacggggccggtaaggggtcgttacggggttcggttaaacggtttgggacgttcgtttagngttacgtcgggttcggggtaaccg

SEQ ID NO: 378265 - DNA, 620 bp, Homo sapiens
  misc_feature: GZ8MTXP01BYR80.38.26.C04.1.454.CMB.2.raw
  modified_base (292)..(292): a, c, t, g, unknown or other
  modified_base (475)..(475): a, c, t, g, unknown or other
  modified_base (534)..(534): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctgggtcctggtgaacggtcccctgcgaaggtcttcgtgggacggcctaccttcagcacctatacttcagtcgtgggtncgacgacggccccgtaggacaagggtcttgaggtggagtaggggaggtactcccgtcccgtatcgttacgaccaaaccgacacctacgacaacacgtaacgttacccaaggaacagaacctcgaacgtacttacccgacgacgaactaccgacgaacgcaacgtagtacctaacgagtggaanatagaacgttacgccgtagagtactccgagaccgacgacggtaccgtgttacttcgtgnggcggaggacggggacgggcgtaggggcgttacgggttcggttaacggttggtccgttgttttggagttagtcggttcgggaacgg

SEQ ID NO: 378266 - DNA, 682 bp, Homo sapiens
  misc_feature: GZ8MTXP01DGP9K.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctggtgaacggtcccctgcaaggcttcgtggacgcaccttcagcactatacttcagcgtgggtcgcgacgacggccccgtggacgaagggtcttggaggtgggagtggggaggtctcccgtccgattcgttcgacctaaacacaacccctacgacaacgtaactaacgtacccgaaggaacacgacctacgaaccgtacgttacccggacggaaccactacccgacgacgaccacgtacgtactaacgagtaggaagtacgtaggaacgtacgtccggtaggagtactacgacgaccgacgtaccggtaccgttgttacgtttccgtaggtcggaacggtagggaacggggcgggggaccggtacgggggtcggttaccgggggtttagggttaaccgggtttaagggttcgttcggttttcgaaggttacggttaacggggttaacggggtaaacccggg

SEQ ID NO: 378267 - DNA, 634 bp, Homo sapiens
  misc_feature: GZ8MTXP01DAYKV.38.26.C04.1.454.CMB.2.raw
  modified_base (536)..(536): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctggtgaacggtcccctgcaaggcttcgtggagcaccttcagcacctatacttcagcgtgggtgcgacacggccccgtggacgaagggcttggaggtggagtggggagggactcccgtcccgtattcgtttacggaccaaaccactacccctacgcaacaacaacgttacccaggaacagaccctacgaacgacttacccggcggaacgaactacccaacggacgacaacgacgtactaacagtggaacgagtagagtaacgccgttagacgtagttacgtacgaaccgaccgacggtaccgttgttactttcgnggtgaacggtagggacggggtcgggggcccgtaagggggtcgttacggggttacggttacggttggtgttcgtttgagttacgtcggttcggggaacg

SEQ ID NO: 378268 - DNA, 744 bp, Homo sapiens
  misc_feature: GZ8MTXP01C4UWK.38.26.C04.1.454.CMB.2.raw
  modified_base (260)..(260): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagagcgtgggtcctggtgaacggtcccctgcaaggcttcgtggacgcaccttnagcactatactttcagcgtggtgcgacgaggccccgtggacaagggtcttggagtggagtggggaggactccgtcccgagttctttaggacaaacaccgacctacgctacaactaacgtaaccgagaacgacgacctacgaaccgacgttaacccggacggtaacgaactcccgaacgacggacaactaacggtactaccgtagttacgggagagtagtaaacgtacgtaccggttaggaacgtaagttccgtaggtaacccggaaccgaccggggtaccccgttagtttaacgttttcccggtcgggacggaacccgggttaagggacgggggtaacggggggcccgggtaacggggggtcggtttaccccggggggttaggggtttaaacccggggttttaaagggggttcggttaaccgggttttttaggtaacccggtttaggtttaaccccgggggttaagggggtaaaaccccggggg

SEQ ID NO: 378269 - DNA, 592 bp, Homo sapiens
  misc_feature: GZ8MTXP01AP7GT.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctcggtgaacggtcccctgcaaggtcttcgtggaggccaccttcagcacctatacttcagtcgtgggtgcgacgacggccccgtggacgaaggtctggaggtggagtgggaggactcccgtccgtattcgttacggacaaaccacgtacctacgacacacaacgttaccgagcagactcgacgtacgtaccgacgacactcgacgagacacagtacacagtgagatagacgtacgacgtgagtatacgtagaccgacgacggtccgtgttacgttcgtggtgcggaggagggtacgggggcgtacgggggtcgttacggggttaggttacggttggtgttaacgtttgagttacgtcggttcgggtaaccgg

SEQ ID NO: 378270 - DNA, 631 bp, Homo sapiens
  misc_feature: GZ8MTXP01E2B9G.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcaacacaagttccaggacagactcacgattaccgcggacgaatccacgagcacagtctacatggagatgagtagcctgagatctgacgacacggccgtgtatttctgtgcgagaggagggggccagggggctcgggtcggtaacggttaggtgtcttttagaattagtcgtcgggggaccaaaggggtacaagtgggtccacccgtctcctcacgccctacccaccgaacgggcccatccggtcccttcccccgtggccacccctccgtccaacgacgccaccgtccgtgggggccacgacggcccggccccgtggggcctcggcccgttgggtaccgaaacgggtaccttaaccgttcccgaaaccggttcgaacgttcggaaccgttggacgggccggggtccgttcgggaaccgg

SEQ ID NO: 378271 - DNA, 651 bp, Homo sapiens
  misc_feature: GZ8MTXP01CA7H1.38.26.C04.1.454.CMB.2.raw
  modified_base (355)..(355): a, c, t, g, unknown or other
  modified_base (447)..(447): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcacgcacctatactttcagctgggtgcgacacggcccctggacaagggctgagtggagtgggagggactcccgtccgattcgtttaggacaaaccncgaccctacgacacaactaagttcccaggcacgacctacgacgtattacccgcggacgaactccgacgagacaccgagtacctacatggganagtagagtacgcgtagagtactacgtacggaaccgacgaaccggtccgttagttaacgttttccgtggttaggtaaccgggtaagggacgggggtaaccgggggccgggtaaacgggggtccgttaccggggttggggttaaaccgtttgggggttagttccggtttttaggacgttacggttccgggttcgggggtaaaccgg

SEQ ID NO: 378272 - DNA, 622 bp, Homo sapiens
  misc_feature: GZ8MTXP01B7BU9.38.26.C04.1.454.CMB.2.raw
  modified_base (451)..(451): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagcgtggtcctggtgaacggtcccctgcaaggcttcgtggagcaccttcagcactatacttcagctgggtgcgacgacggccccgtggacgaagggtcttggacggtggagtggggacggtactcccgtccgtagttcgttcggaccaaaccacaccctacgacacactaacgtaccaaggaacagacctacacgacttaccggacgacgactccacgacgacacagtactacgagtagganagtgagtacgcgtagagtactcgtagaccgacgtacggtaccgtgttacttcgtacggtcggaaccggagggacggggacgggggaccgtagggggtcgttacgggggttaggttaaccggttaagggttcgttaacgttttggattacggtcggttaacggggtaaccgg

SEQ ID NO: 378273 - DNA, 673 bp, Homo sapiens
  misc_feature: GZ8MTXP01BR6C5.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctggtcctcggtgaacgtcccctgcaagcttcgtggagcaccttcagcactatactttcagcgtgggtcgacgtacgacggccccctaggacaagggcttgagtggagtgggggaggtactcccgtcccgtagttccgtttaggaccaaaccgtacaccccttacgacaccacgtaacgttacccaaggtaacacggaccttccgaacgtacttacccggacggaaacccgaactcccgaacgacgacacgagtacccgtacagttggaagtacgtaggtacgtacgacggtagagtaactcgtacgaccgaccgtacggtccgttagttactttccgtggtcggaacggaagggcgggaacgggggcccgagggggtccgttcgggggttacgggtttaaaccgggtttgggtggtttccgttttggaacgttgggttcggttaaccggggaacccggg

SEQ ID NO: 378274 - DNA, 695 bp, Homo sapiens
  misc_feature: GZ8MTXP01CYDM8.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctggtgaacggtcccctgcaaggcttcgtggaggcaccttcagctacctatactttcagctgggtgcgacgacggcccctaggacgaagggcttggaggtcgggaggtagggggacggtcctcccgtaccgtacgttacgttacggaaccaaaccacctaccccgtacgacaaccaaccgtaacgtaacccgaacgaacaacgtacctaaccgaacgtacgtacccggacgaacgtacctaccgagacacaacgtacgtacctagaggtacgagagtagtaacgtcgacggtaggaacgtacgtacgtacgaaccgtaccgtacggtaccgtttgttacgttcgtaggcggtaacgggaagggttacgggggaccgggcggtaacgggtcggttaccggggtttgggttaaacgggttaacgggtttacggtcggttttagttaggttacgtttaacggttccggggtaacgggg

SEQ ID NO: 378275 - DNA, 682 bp, Homo sapiens
  misc_feature: GZ8MTXP01AK2EK.38.26.C04.1.454.CMB.2.raw
  modified_base (503)..(503): a, c, t, g, unknown or other
  modified_base (510)..(510): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttcgtggacggcaccttcagcacctatactttcgagtcgtgggtgcgacgacggcccccgtggacgaagggtcttaggaggttggacgtgggggacgggtactcccgtacccggtacttcgtttacgggaccaaaccgtaccaacccgtaccggcaacaaccgtaacgttaacccgaacgggaaccaaggacctacgaaccgtacgtttaccggacgggtaaaccgaactacccgaacggacgactaacgagtacctaanagtgganagttcgagttagccgtaggacgtatcgtacgaccgacgaccgggtaccgttagttactttcgcggcggaacggaggacggggacgggggcccgtagggggtcgttacggggttcggttaacggtttaagggtcgttcgttttaggattcggtaacgggttggggtaacccgg

SEQ ID NO: 378276 - DNA, 660 bp, Homo sapiens
  misc_feature: GZ8MTXP01DEUYE.38.26.C04.1.454.CMB.2.raw
  modified_base (435)..(435): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggctaccttcagccactatactttcagcgtgggtgccgacgacggcccctaggacgaagggcttgaggtggagtggggaggactcccgtcccgattcgtttgaccaaaccacaccctacgacaacactaacgtcccaaggcacgaacctcgaacgacgtaccggacgtaacgaatcccacgancaacagtactaacagtacgggaatgtagacgtaacgcgtaggaagtacgtcgtaacggaccgaccgtaccggtaccggttgttaactttcgtggttcggaaggaagggacggggtacgggggaccgacgggggttcggttaccggggttagggttaaccggtttaaggggtctttaacggttttagggtaacgttacggttaacgggttcgggggtaaacccggg

SEQ ID NO: 378277 - DNA, 638 bp, Homo sapiens
  misc_feature: GZ8MTXP01CF801.38.26.C04.1.454.CMB.2.raw
  modified_base (280)..(280): a, c, t, g, unknown or other
  modified_base (348)..(348): a, c, t, g, unknown or other
  modified_base (401)..(401): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcaggtctggggctggaggtgaagaagcctgggtcctcggtgaacggtccctgcaaggcttcgtggagcaccttcagcacctatacttcagctggtncgacaggcccctggaccaagggcttgagtggagtggggaggatccgtccgattcgttggactaaaccncactacgcccacacaagtcccaggaacagctcacgacttaccgacgaacgaanccacgacgcaactagtactacgagtggaatagagaacgtacgaccgttaggaagggtaacttcgtaacgaaccgtacgaaccgggtcccgttaggttactttccgtggtaggtccggaaaggaacgggacgggggcccgaaagggggttccgtaccgggggttagttaaccgggttaggttcggttaagttttaggaagttacgtcggttacggggaacccgttaaagggtaaccgg

SEQ ID NO: 378278 - DNA, 606 bp, Homo sapiens
  misc_feature: GZ8MTXP01DWZX9.38.26.C04.1.454.CMB.2.raw
  modified_base (224)..(224): a, c, t, g, unknown or other
  modified_base (258)..(258): a, c, t, g, unknown or other
  modified_base (282)..(282): a, c, t, g, unknown or other
  modified_base (428)..(428): a, c, t, g, unknown or other
  modified_base (443)..(443): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagcctgggtcctggnaacggtccctgcaaggcttcgtggaggcaccttnagcacctatactttcagctgggtncgacacggcccctggacaaagggcttgaggtggagtgggagggatcccgtccgtattcgtttcgaccaaacacacctacgacacgaacaacggttacccaggaacagactacgacgtacttaccgcggaaacgaactccacggacncaaccagtacctaanagtaggagtagagaagtacgacggtagacgtactacgagacgacgacggtacgttgttatttcgtgtggaacggaggaggggacgggacggtacggggtcgttacgggttgggttaacggttggttgttcgtttaggagttacggtcgggttaacgggtaacg

SEQ ID NO: 378279 - DNA, 692 bp, Homo sapiens
  misc_feature: GZ8MTXP01CRQ4M.38.26.C04.1.454.CMB.2.raw
  modified_base (251)..(251): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcgagtcgtggggctggaggtgaagagcgtgggtcctggtgaacggtccctgacgaaggtcttcgnggacggctaccttcacgtcctaccgtatacttcaggtcgtagggtcgaccgacgtacggccccgtaggaacgaagggtcttaggaggtgggtaagtgggggacggtaccttcccgtacccggtagttaccgtttacggaacctaaaccgaccgaaccctaccgacgtaactaaccgtaacgttacccgaagtaacgactacgaccgtaacgaacgtaccggacgaaactaacgccgaacgaacgacaccgtagtactacgagtacggaagagttacgaagtacgtacggagtagacgtacgacgtaccgacgtacgtccgttgtatttcgtgtgaacgggtagggagggaccggggttcgtaggggtaccgttcggggttaggttacggttaagggtgtttaaccgttaggtagttaccggttaagggcccggtaaacggg

SEQ ID NO: 378280 - DNA, 643 bp, Homo sapiens
  misc_feature: GZ8MTXP01EPLX8.38.26.C04.1.454.CMB.2.raw
  modified_base (252)..(252): a, c, t, g, unknown or other
  modified_base (300)..(300): a, c, t, g, unknown or other
  modified_base (346)..(346): a, c, t, g, unknown or other
  modified_base (499)..(499): a, c, t, g, unknown or other
  modified_base (517)..(517): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgcttgttgtactgctcctcccgattctttggaccaaaccacactacgcacacaagtccaggacagacctcacgacttaccgngaacgaatccagagcacagtctacagtggagatgaagttagcctaganatctagaccgacgacggtccgttgttatttcgtgtgcggagagggngggggccgaggggtcgtcggggtacggtaacggtttaggtgtcgttttagaagttacgttcggtagggggacccaaaggggacctaaagtcgggtacctacgttcctcctcacgtcctaccaacgaacgggtcccagtcccgtcttcccccgngcccaccctcgcaagtcncaccgtcggcgggacacgacgtcccggccgtcgggctaacgccgttgggtaaccacggaccttacccgttccgttagttaccggtaatccgtaacgagggacggttcccgggtcgaacgggaaccg

SEQ ID NO: 378281 - DNA, 590 bp, Homo sapiens
  misc_feature: GZ8MTXP01A9SSG.38.26.C04.1.454.CMB.2.raw
  modified_base (363)..(363): a, c, t, g, unknown or other
  modified_base (504)..(504): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagcgtgggtgcgacacggcccctggacaagggcttggaggtggagtggggagggtactcccgtcccgagttcgtttggacctaaaccncaccctacgcacaacacgttaccaggcagactcaccgtagtaccgcgaacgaatccacgacgacacagtactacagtaggagagtggaagtacgccgttaggacgatacgtgaaccgacgaccggtccgtgttactttcgnggcgcgaggaggacggggccgaggggtccgttagggttcggttaacgttgggtagttcgttttgacgttgtcggttggggtaaccg

SEQ ID NO: 378282 - DNA, 602 bp, Homo sapiens
  misc_feature: GZ8MTXP01C7YUE.38.26.C04.1.454.CMB.2.raw
  modified_base (235)..(235): a, c, t, g, unknown or other
  modified_base (382)..(382): a, c, t, g, unknown or other
  modified_base (425)..(425): a, c, t, g, unknown or other
  modified_base (428)..(428): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagctgggtcctggtgaacggtccccngcaaggtcttcgtggagctaccttcagcacctatacttcagcgtgggtgcgacgacggccccgtggacgaagggcttaggaggtgggagtgggggacgggtactcccgtcccgattcgttacggacctaaacacacccgtacgacanacagtaccagcagactacacgtactaccgcgacactacacgancanacgtacacgagtaggagagtagagtagcgtagagattcgagaccgacgacggtaccttagtactttcgtaggtggaacggaggaggggaccgggggcggtagggggtccgttcggggttacggttaacggttgggtcgttgttttaggcgtttacgtcgggttggggtaaccgg

SEQ ID NO: 378283 - DNA, 634 bp, Homo sapiens
  misc_feature: GZ8MTXP01DY8D3.38.26.C04.1.454.CMB.2.raw
  modified_base (234)..(234): a, c, t, g, unknown or other
  modified_base (284)..(284): a, c, t, g, unknown or other
  modified_base (421)..(421): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcgtgggtcctggtgaacggtcccngacaggcttcgtggaggctaccttcagctacctatacttcagcgtgggtncgacgcggcccctggacaggtctggagtgggagtgggaggactcccgtccgattcgtttacggacaaaccactaacgtacgacacaactacgtaccgagaacagactcaacgtactaccggacgacactccaggacncatacgtacctagagtcggaagagtggaacgttacgcgttaaggagtaaacgtcgtaacggaccgtaccggaccggtacgttacgttacgtttcgtacggtcggaacggtagggacgggacgggggacccgagggggtccgttaggggttacgggtttaaacggttgggttacgttcgtttagacgttacggtcgggttaacggggaaaccgg

SEQ ID NO: 378284 - DNA, 550 bp, Homo sapiens
  misc_feature: GZ8MTXP01C3T3E.38.26.C04.1.454.CMB.2.raw
  modified_base (433)..(433): a, c, t, g, unknown or other
  modified_base (455)..(455): a, c, t, g, unknown or other
  modified_base (465)..(465): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagctgggtgcgacaggcccctggacaagggcttgagtggatgggaggctcctccgatcgttggacaaacacactacgcacacaagtccagcagactcacgactacgcggacaactccacgagcacagtactacgatggagatgatagcgtgagatcgngacgacgaggccgtgtattcgngtgcgaaggnggacggggccgaggggtcttaccgggttggttaacggttaagggttgttaacgttttggagttacgttcggttggggtaacccgg

SEQ ID NO: 378285 - DNA, 820 bp, Homo sapiens
  misc_feature: GZ8MTXP01EW6IL.38.26.C04.1.454.CMB.2.raw
  modified_base (267)..(267): a, c, t, g, unknown or other
  modified_base (269)..(269): a, c, t, g, unknown or other
  modified_base (273)..(273): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtagaagaagccgtgggtcctggtgaacggtcccctgacgaaggtcttcgtagggacggacctncnctcnactactactctctactacgtacgtacgtcggtcggtacggtaccggtacccggtacccggtaaccgggtaaccgggtaacggtaacggtacgggtacggtacgggtaacggggtacggggtacggtaccggtaccggtaccgttaccgttacccgttaccgtaacgtaacccgtaacccgtaacccgtaaacccgtaacccgtaaccgtaaaccgtaaaccgtaaaccgtaacggtaaccgtaacgtaaccgtaaccgtaaccgtaaccgtaaccggtaaccggtaaccgtaaccgtaaccgtaaccgaaccgaacgtaacgtaacgtaacgtaacgtaacgtaacgtaacgggtaacgtaaggtaacgtaacgtaacgtaacgtaacgtaacgtaacgtaacgtaaccgtaaccggtaccgtaacggttaacgttaacgttacgttacgttacggtacggtaacgggacgggacgggacgggtaaccggggtacgggtaacgggttacgggttacgggttacgggttaacggtttaacggttaacg

SEQ ID NO: 378286 - DNA, 606 bp, Homo sapiens
  misc_feature: GZ8MTXP01CWX25.38.26.C04.1.454.CMB.2.raw
  modified_base (277)..(277): a, c, t, g, unknown or other
  modified_base (279)..(279): a, c, t, g, unknown or other
  modified_base (291)..(291): a, c, t, g, unknown or other
  modified_base (319)..(319): a, c, t, g, unknown or other
  modified_base (368)..(368): a, c, t, g, unknown or other
  modified_base (473)..(473): a, c, t, g, unknown or other
  modified_base (491)..(491): a, c, t, g, unknown or other
  modified_base (597)..(597): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttgcaaaccacactacgcacacaagttccaggacagactcacgattaccgcgacgaatccagagcaacagtctacagtgganangagtagcctganatctagacgacacggtccgtgttattcngtgcgagagggacgggggccagggggctcgggtaggtaacggttaggtntcgttttgaagttatcggtaggggaccaaaggggacctaagtcgggtacaccgtcttcgcacgcctaccaccgaacggcccatcccggtccttccccgtgacccncccgtctccgaaacgacncccgacctcgcgggcaccgacgccgggccctcggactcggaccgttggaccaaacggtccttaaccttcccgaaggttcgtaatccgaacgtcggcggccgggtcncgggaaccg

SEQ ID NO: 378287 - DNA, 756 bp, Homo sapiens
  misc_feature: GZ8MTXP01BT25A.38.26.C04.1.454.CMB.2.raw
  modified_base (298)..(298): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctcgggtgaacggtcccctgcaaggtcttcgtgggagcctaccttcacggctacctatactttcgagtctggggtcncgacgcggccccgtggacaagggtcttaggagtcggagtggggacgggtactcccgtccgatcgtttacggacctaaaccgctaccctacgacaacgactaacgttaccagtcagacctcacgtacgttaccgacgacgactccgacgacgacgacgacgtactacgacgtagggacgtagtacggtacgtacggtacccgggtaaggtaacgtaacgttaccgtacggtaaccggtaccggtaaccgggtacccgtttggttaaaccgttttcggttacggttacgggtaacccggtaaggggttacgggggtaacgggggttcccgggtaagggggttacccgggtttacgggggttacggggtttaaccggggttttaacggggttaccggtttaacggttttttcgggaacggttttaccgggttccggggttaaccgggggttaaacccgggg

SEQ ID NO: 378288 - DNA, 640 bp, Homo sapiens
  misc_feature: GZ8MTXP01BNHI6.38.26.C04.1.454.CMB.2.raw
  modified_base (549)..(549): a, c, t, g, unknown or other
  modified_base (562)..(562): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagcctgggtcctcggtgaaggtcccctgcaggcttcgtggaggcaccttcagcacctatacttcagcgtgggtcgcgacgcggcccctggacgaagggtcttaggaggtggagtgggggacgggtactccccgtccgtattcgtttacggacaaaccacacccgtacgcaacacctaacgtaccaagggcacgactacgacgacgttaccggacggaactaactcccacggaacgaccacgtacgtaccaaccgtagtagggaagacgttaggaacgttacggccgtaggaagtactacggtacgaaccgacgaccgggttccgtagtttaccttcgnggtgaacggaggnggggtaacggggcgtaggggcgttacgggttcggttaggttggtgttcgtttgagttacggtcggttcgggtaaccgg

SEQ ID NO: 378289 - DNA, 656 bp, Homo sapiens
  misc_feature: GZ8MTXP01DH5K6.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagcgtgggtcctggtgacgtccctgcaggtcttcgtggagcaccttcagcacctatactttcagcgtggtgcgacgacggccccgtggacgaagggcttggaggtggagtggggagggtactcccgtccgtattcgtttacggaccaaaccactaaccctaccggacacaactaacgttacccgaggaacacgactacgaacgtacgtaccggacggaacaactccgaacgagaccaacacgtactacagtaggagagtgaacgtacgaccgtaggagtacgttacgaggaaccgacgtaccgggtaccgttagttacgtttcgtcggtaggaacggtagggaggggaccgggggccggtagggggtcgttacggggttacggggttaacggtttgggttgtttaacgttttaggagttacggttcgggttaacgggggtaaaccggg

SEQ ID NO: 378290 - DNA, 741 bp, Homo sapiens
  misc_feature: GZ8MTXP01ERTUL.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctggtctcggtgaagtcccctgcaggcttctggagcaccttcagcacctatactttcagctgggtgcgacacggcccctaggaccgaaagggtcgttagagtggagtagggggaggatcccgtcccgattcgtttacggacctaaacccgacaacccctaaccggacaacaacgaaacgttacccaaggaaccagaacctcgaacgtacttaaccggacggtaacgaaactcccaaacgaacgcaacagtactaacgataggagagtagaagtacgccgttaggaaggtacttacgacgaaccggaaccgaccgggtacccgttagggttaacttttccggttcggacccggtaacgggtaaggggaacgggggtaaacggggggttacccggggaaaccggggggtccgggttacccgggggttaagggggtttaaacccgggtttaaagggggttcgtttaaccgggtttttttaacggggaacgtttagggtttaaccggggttaacggggggttaaaaccccggggg

SEQ ID NO: 378291 - DNA, 646 bp, Homo sapiens
  misc_feature: GZ8MTXP01CFB94.38.26.C04.1.454.CMB.2.raw
  modified_base (316)..(316): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccagagcacagtctacatggagatgagtagcctgagatctgacgacacggcgtgtactttcngtgcgaggaggagggggccagggggctggggtacggtaacggttaggtgtcttttgaattacgtcggtacgggggaccaaaggggtacaagtcgggtacacccgttcgtccctcgacgccctaccgaacccgaacgggcccctacgttcccggtcccttcccccgtcgggcccctaccccgtcccgtacccgaacggaccgccgtacccgtcggcgggggaccaaccggcggtccggcccgtgggccgtcggtccgttcggtaccgaacggtaccttccgttaccgacgttcgtaactcgaacgtcggacgggcgggtcgcgggaaccgg

SEQ ID NO: 378292 - DNA, 779 bp, Homo sapiens
  misc_feature: GZ8MTXP01A6QD4.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttcgtggaggcaccttcagcacctatacttcagcgtgggtcgcgacgacggccccgtggacgaaagggcttaggagtgggagtggggaggactcccgtcccgagttccgtttggaccaaaccactaaccccgtaccggacaaccgaacgaaacgttaccccgaagggtaacaacgtaacctaccgaaccggtaacgttaaccccgggacgggtaaaccgaaacgtacccgaaccgggaacgaccgaaaccgtacgttaaccgttaaaccgacgttaggggaaacgtaacgtagggtaacggtaacggacccgggttaggaaacggtacgtacccggttaacggaacccgtaacggtacccgggtaacccgtttaggttaaccgttttccgtgggttcggaaccggtaagggacggggtacggggggaccccggtaagggggtcccggttacggggttacggggtttaaaccggttaaggggttcggtttaacgttttacgggtaacgttacgtcccgggttcgggggtaaacccggg

SEQ ID NO: 378293 - DNA, 685 bp, Homo sapiens
  misc_feature: GZ8MTXP01BBC24.38.26.C04.1.454.CMB.2.raw
  modified_base (257)..(257): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagccgtggtcctcggtgaacgtccctgcagtcttcgtggagctaccttnagctactatacttcagtcgtggtgcgacgacggccccgtggacgaggtcttaggaggtggaggtggggacggtactccccgtccgtagttcgttacggaccaaaccacctacccgtaccgacaaccgtaacgtacgttacccgaaggtaaccacgtaacctaccgaaccgtacgttaaccccgggacggtaaacccgtaacgtacccgaacgacgacctaacgtacgtactaacgagtaggagagtagtacgtacgacggtagagtactacgtacgaccgtacgacggtccgttgttacgttcgtcgtcggaacggacgggacgggggacggggttccggtacgggggtcggttacggggttacgggttacgggttgggttcggttaacgtttaggacgtttacggtccgggttaacggggtaaccgg

SEQ ID NO: 378294 - DNA, 675 bp, Homo sapiens
  misc_feature: GZ8MTXP01D24B8.38.26.C04.1.454.CMB.2.raw
  modified_base (225)..(225): a, c, t, g, unknown or other
  modified_base (234)..(234): a, c, t, g, unknown or other
  modified_base (244)..(244): a, c, t, g, unknown or other
  modified_base (247)..(247): a, c, t, g, unknown or other
  modified_base (250)..(250): a, c, t, g, unknown or other
  modified_base (253)..(253): a, c, t, g, unknown or other
  modified_base (265)..(265): a, c, t, g, unknown or other
  modified_base (558)..(558): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcgtgggtcctggngacgtcccngcagtcttgnggngcnctnagcactatcttnagcgtggtcgcgacgcggccccgtaggacgagggtcttggaggtggagtgggaggtactcccgtcgattcgttacgaccaaccactaccgacgacaactacgaacgtaaccaggtaacagtacctacgacgtacgtaccggacggaacaactaccgacgacgactaactacggtacacgtaggtacggaagacgttacggaagtaccggaccggttaaggacgtacgttacggaccggaccgtaacgaccgggttccgttagttacgtttcgcgggacggtaagggaacgggngggggtaccgggggttacggtacgggggttccgggttacggggttacggggttacggttaacggggtgtttaacggtttggtacggttacggttcggggttaaccggggtaaaccgg

SEQ ID NO: 378295 - DNA, 779 bp, Homo sapiens
  misc_feature: GZ8MTXP01BY6J0.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggagcaccttcagcacctatactttcagctgggtgcgacgacggcccctaggacaagggcttggagtggagtggggagggtactcccgtcccgagttcgtttacggacctaaaacccgactaacccctaccggaccaaccgaaccgtaaacggttaaccccgaaagggtaaccaacggtaacccttaccgaaccggtaacgtttaaccccgggacgggtaaacccgtaaactacccgaaaccggaacggacccaaccgaacggttaccctaaacgtagtacggggaagtaacgtacggaagggttacgtaccggtaagggtacggtaacgtcgtaacggaaccggaaccggtaacccgggtcccggtttggttaacgtttccgttagggttaggaaccgggaagggacggggtacggggggcccgtaacggggggtccgttacgggggtttacggggttaaaccggggttttggggttcggtttaaccgtttttagggagtttacgggtccgggttcggggggaaaccccggg

SEQ ID NO: 378296 - DNA, 626 bp, Homo sapiens
  misc_feature: GZ8MTXP01B1N2J.38.26.C04.1.454.CMB.2.raw
  modified_base (318)..(318): a, c, t, g, unknown or other
  modified_base (329)..(329): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggngggggccaggggctggtcggtaacgttggtgtctttgaattagtcgtggggacccaaaggggactaagtcgggtacctacccgtctcctcacgccctaccaccgaacgggccctacgtccgggtacccttcccccgtcggaccctaccccgtcccgtaccaacggaccgcctaccgtccggtcgggggccaccgacggcccgggcccgtcggggccttcgggtcccgttgggtaccaacggtacctaccgttccgacgttcgaacgtcaacgtggacggttcgggcgttcgggaacg

SEQ ID NO: 378297 - DNA, 625 bp, Homo sapiens
  misc_feature: GZ8MTXP01BABS7.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctagagatcgtgaacgacgacggtccgttgtatttcgtgtgcgaggaggagggggcaggggctcggtaggtacgttaggtgtctttgaattagtcgtggggaccaagggacaagtcggtcaccgtctctcacgcctaccaccgaacgggccctacgtccggtcccttacccccgtcggaccctacccctccgtacccgaacgtacgccgtacctcggtcgggggccaacgcggcccggtcccgtcgggcctcgggcccgttgggtaccgaacggtacctaaccgttccgacggttcgaagttccggaacgtcggacgggccgggtcgcgggtaaccgg

SEQ ID NO: 378298 - DNA, 674 bp, Homo sapiens
  misc_feature: GZ8MTXP01BUSVB.38.26.C04.1.454.CMB.2.raw
  modified_base (261)..(261): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctcggtgacggtcccctgcaaggtcttcgtggagcaccttnagcacctatacttcagctgggtcgcgacgacggccccctaggacgaagggtcttaggaggtggagtgggggagggtactcccgtccgtattccgtttacggaccaaaccacaccctaccgacacaactacgttaccaggaacagacctacaacgtacgttacccggacggaaaccgaactacccgaacgacgaccaacgtagtaacctaacgtagtagggagtagtacggaagttacgaccggtaggacgtactacggtcgaaccgacgtacgggtaccgttgttactttcggtagtggaacggtaggacggggtacgggggccggtaagggggtcgttacggggttagggttaaaccgggtttgggtacgtttcgtttaggagttacggtccgggttaacggggtaaaccgg

SEQ ID NO: 378299 - DNA, 556 bp, Homo sapiens
  misc_feature: GZ8MTXP01DV6AM.38.26.C04.1.454.CMB.2.raw
  modified_base (489)..(489): a, c, t, g, unknown or other
  modified_base (493)..(493): a, c, t, g, unknown or other
  modified_base (509)..(509): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagctgggtcctcggtgaagtcccctgcaaggcttctggaggcaccttcagcacctatactttcagctgggtgcgacaggcccctggacaagggctgagtggatgggagggactcctcccgattcgtttggacctaaaccactacctacgacacacaacgttcccaaggaacagactacaacgacgttacccgcggaacgaactcccgagacgcacagtactacagtggagatgagtacgcgtagagtactcgagaccgacgacggaccatcgtatttcgngtgnggaggagggcgggcgngggttcgttgggttaggtaagtggtgttcgttagagttcgcggtggg

SEQ ID NO: 378300 - DNA, 621 bp, Homo sapiens
  misc_feature: GZ8MTXP01DKFFN.38.26.C04.1.454.CMB.2.raw
  modified_base (238)..(238): a, c, t, g, unknown or other
  modified_base (294)..(294): a, c, t, g, unknown or other
  modified_base (371)..(371): a, c, t, g, unknown or other
  modified_base (375)..(375): a, c, t, g, unknown or other
  modified_base (451)..(451): a, c, t, g, unknown or other
  modified_base (609)..(609): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtccccngcgaaggtcttcgtggaggcacccttcagccaccttatactttcagtcgtgggtcncggacgacggcccccgtaggaccgaaggtcttggagtgggagtggggaggtactcccgtccgattcgttcgacaacncacncgcacacacgtccaagcacgactcgaacgacttaccggcgacgaactccgaacgacgcacgagtactacgagtganagtgagtgccgtagagtattcgacgacgcgtacggtacgttgttacgtttcgtggtcggcggtaagggacggggtacggggccgggtagggggtcttaccgggggtttaggttaccgggtttgggtacgtttccgttttaaggagttacggtccgggnggggtaaccggg

SEQ ID NO: 378301 - DNA, 784 bp, Homo sapiens
  misc_feature: GZ8MTXP01AXMAG.38.26.C04.1.454.CMB.2.raw
  modified_base (632)..(632): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctcggtgaacggtcccctgcaaggtcttcgtgggacggctacccttcagtccaccttattactttcgagtcgtagggtcgaccggtaccgacggtccccccgtagggaaccgtaaacggggtcctttaggaggtagggaggtgggggacgggtactccccgtacccgtattccgtttacggaccaaaccacgtaaccccgtacgacaacaaccgtaacgttaacccgaacggaacacgtacctaccgaaccggtacgttacccgggaccgaaacgtaactaaccgaaccggaacaccgaaccgtagtacctaacgtaaggtaggaacgtagtaacggtaacgttacgccggtaggtaagtacgttacgtaacggaccggtaacgaccgggttaccgtttagtacgtttccgnggttcggaacgggtaacgggacgggggaacgggggcccggtacgggggtccggtttacgggggttacgggtttaaccggggttaaggggtttacgttccgggttttaaggtacgttacgggttaaccggggttaacgggggtaaacccgggg

SEQ ID NO: 378302 - DNA, 642 bp, Homo sapiens
  misc_feature: GZ8MTXP01A9SMJ.38.26.C04.1.454.CMB.2.raw
  modified_base (290)..(290): a, c, t, g, unknown or other
  modified_base (525)..(525): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagcctgggtcctcgggtgaacggtcccctgcaaggcttcgtggaggctaccttcagctacctatactttcagtcgtgggtncgacgacggccccgtggacaagggtcttaggaggtggagtggggaggtactcccgtccgattcgttacgacaaaccacacctacgcaacactaagtcccaaggccagcctacacgtacgtaccgacggaacgactccgacgacgaccaacgtacgtacgtaacagtagggagtaatggaagtacgccgtaaggacgacttcgacgaacgtacgaccggttcgtattacgtttcgnggtaggtaacggagggacggggacggggccggagggggtcttcgggggttcggtttaacggggttggttcggttcgttttgggaacgtttacggtccggggttaaggggtaacccgg

SEQ ID NO: 378303 - DNA, 639 bp, Homo sapiens
  misc_feature: GZ8MTXP01C9XXJ.38.26.C04.1.454.CMB.2.raw
tcagtcgatcacgtcacgaccggtgctcgatttagtctagcgactttgggtttggggatcacataacaacccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaacgtccctgcaaggcttcgtggagctaccttcagcacctatactttcagtcgtgggtgcgacacggccccgtaggacaaggcttgaggttcggagtggggaggactcccgtcccgagttcgtttacggaccaaaccgaccaaccgtaccgacaacaacgaacgttaccgaggaacagactacacgacgtaccgcgaacaactccacgacgcaactacgtactacgagtggagagtgaacgtacgaccggtagagtactcgtacgaaccgacgtaccggtaccgttgtttaacttcgtcggtggaaccggaagggacgggacgggggaccgtagggggtccgttacggggttcgggttaacggtttgggtagttcgttttagggactttacgggtccggttggggtaaacccgg

SEQ ID NO: 378304 - DNA, 666 bp, Homo sapiens
  misc_feature: GZ8MTXP01AUCZ4.38.26.C04.1.454.CMB.2.raw
  modified_base (655)..(655): a, c, t, g, unknown or other
  modified_base (661)..(661): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactcgcctcctcccgatctttggacaaaccacactacgcacacaagtccaggacagactcacgacttaccgcgacgaatccacgagacacagtctaacagtggagatgagtagcctgagatcgtaggaaccgacgacggtcgttgttacgttcgtggtcgacggaggacgggacgggggccgagggggtcgtgggtacggttaacggttaggtgttcgtttagaattaggtcggtacggggtaacgaaacgggtactaagttcgggtactacccgtccgtaccctcgacgtccccgtaaccgaccgaaccgggtccctacgttccccgtccctccccgtcgaccctaccccgccgtacgaacgacgcccgtaaccgtcgggtcgggaccacggacggtcccggtcccgtgggccttaacggccgttaggtacgaacgtaccgtccttccgagttcggaacgtcgaacgtggacgggngtccgngaacg

SEQ ID NO: 378305 - DNA, 756 bp, Homo sapiens
  misc_feature: GZ8MTXP01BECYC.38.26.C04.1.454.CMB.2.raw
  modified_base (248)..(248): a, c, t, g, unknown or other
  modified_base (259)..(259): a, c, t, g, unknown or other
  modified_base (284)..(284): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagacgccgtgggtcctggtgaacggtccctgcaagcttgnggagctacctnagccactatcttcgagtcgtgggtncgacgacggcccctaggacgaagggtccttaggaggtggagtagggggacggtactcccgtcccgtattccgtttacggacctaaaccgacctaccgtaccgaccaaactaaccgaacgttacccgaaggaaccgtaagtaaccttacccgaacgtaccgttaacccgggaccgggtaaacgtaaccctaccgaacgacgacctaaccgagttaacctaacgtagtaacggagagtacggtaaggtaccgtacccgtaaggtaacgtacgttaccggtacggaacccgtaaccgtaccgggttacccgttaggtttaacgtttccgtagggtcgaacgggtaagggacggggtccgggggttacccgggtaaaggggttccggttacggggtttcggggtttaaaccggttgggttagtttaacccggttttagggacgtttaccggtcggggttaacggggtaaacccggg

SEQ ID NO: 378306 - DNA, 659 bp, Homo sapiens
  misc_feature: GZ8MTXP01EL9X9.38.26.C04.1.454.CMB.2.raw
  modified_base (331)..(331): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggccaaaccacactacgcacacaagttccaggacagactcacgataccgcgacgaatccacgagcacagtctacagtggagatgagtagcctgagatctgacgacgacggcgtgtatttctgtgacgaggaggngggggccgaggggcgtcgggtacggtaacggttaggtgtcgttttagaattagtcggtggggaccgaaagggactaagtcggtctaccgtctacctcgacgccctaccgacgaacgggccctacgtcccggttcccttcccccgtggacccctaccccgttccctacccgaaacggtaccgcccgtaacccgtccggtcgggggaccaaccgccgggcccgggtcccgttcggggcctcggtacccggttcggtaccggttaaacggtaccttaccgttccgacgttcgaacttcggaacgtcgggcgcggggtccgttgggaaccgg

SEQ ID NO: 378307 - DNA, 638 bp, Homo sapiens
  misc_feature: GZ8MTXP01DYX5R.38.26.C04.1.454.CMB.2.raw
  modified_base (316)..(316): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttgcaaaccacactacgcacacaagttccaggacagactcacgattaccgcgacgaatccacgagcacagtctacatggagatgagtagctgagatctgacgacacggccgtgtatttcgngtgcgagaggagggggccaggggctacggtcggtaacggttaggtgtcttttagaattagtcggtaggggaccaaaggggactaagtcgggtcacccggtctcccgttacgacgcctaccaacccgaaacggccctaagtccggtccttcccccgacggtaccctaccccgtcctaccgaacgtacgcctaccgtcgtcgggggcaaccgcggccggtcccgtggcctcggccgttcggtaccttaaacgggtaccttaaccgttcccgagttaccgaagttccggaacgttcggaacggttccgggcgttcgggtaacccg

SEQ ID NO: 378308 - DNA, 698 bp, Homo sapiens
  misc_feature: GZ8MTXP01AFK9E.38.26.C04.1.454.CMB.2.raw
  modified_base (490)..(490): a, c, t, g, unknown or other
  modified_base (610)..(610): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagcctgggtcctcggtgaacggtcccctgcaaggcttcgtggagcaccttcagcacctatacttcgagtcgtggtgcgacgacggccccgtggacgaagggtcttaggaggtggagtgggggaggtactcccgtcccgtagttcgtttacggaaccaaaccacgtacctaccgacaacaaccgtaacgttaacccgaaggaacacggaacctacgaaccgtacgttacccggacgggaaacctacgtacccgaacggacgaccctaagtacgtaccctaanagttacggaagaagttggaagttaacgccgttaggacgtattccgaaggaccgacgtaccgggtccgttagtttacgttccgttggcggaaggtacgggttaggggccgggggttacggngggggtacgttcgggggttcgggttaaaacgggtttgggtggttttcttttagggaagtttcggtccggggttcgggggtaaacccgg

SEQ ID NO: 378309 - DNA, 686 bp, Homo sapiens
  misc_feature: GZ8MTXP01ARJ94.38.26.C04.1.454.CMB.2.raw
  modified_base (248)..(248): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgnggaggcaccttcagcacctatactttcagtcgtggtgcgacacggcccctggacgaagggcttgaggtggagtggggacggactcccgtacccgatcgtttacggaccaaaccacgaccctaccgacaaccgactaacgttacccaagggaacaacgacctacgacgtacttacccggacggaacgaactccgaacgacgaccaacaggtacctaacgagtagggaagtagtaggaacgttacggaccgttaggaacggtactaccgtagacccgaaccgtaccggtacccgttgttaacgtttccgtaggtcggaacggaaggacggggtaaacggggcccggtacgggggtcgttccggggttacgggttaaaccgggtttaaggtcggttaaccgttttaggagtttacgttccgggttaacggggtaaacccgg

SEQ ID NO: 378310 - DNA, 658 bp, Homo sapiens
  misc_feature: GZ8MTXP01C4RQA.38.26.C04.1.454.CMB.2.raw
  modified_base (276)..(276): a, c, t, g, unknown or other
  modified_base (450)..(450): a, c, t, g, unknown or other
  modified_base (535)..(535): a, c, t, g, unknown or other
tcagtcgatcacgtcacgaccggtgctcgatttagtctagcgactttgggtttggggatggttttctcgatgggggctgggagggctttgttggagaccttgcacttgtactccttaccattcagccagtcctggtgcaggacggtgaggacgctgaccacacggtacgtgctgttgtactgctcctccgatctttggcaaaccacactacgcacacaagttccaggacagactcacgataccgcgacgaactccacgagcacagtctacatgganatgagtagcctagagatctagaccgacacggtccgtagttactttcgtggtggcggaaggagggacggggggccagggggctcggggtaggttaaccggtttagggtgttcgttttagagtaacgttcggtcgggggaccaaaggggactaagtcgggtactacgtcgtcctcncgacgcctaccgaaccgaacgggccctacgttcccgggtccccttaccccgtcggacccctaccccgtcctacccgaacggaccncccgtaccgtcggcggggccaacggacggcccggccgtcgggcctcggccgttcggtaccgaacggtacctacgttaccgcgttacgaacgtcgaacgtggacggcgggtcgttcgggaaccg

SEQ ID NO: 378311 - DNA, 629 bp, Homo sapiens
  misc_feature: GZ8MTXP01B57WH.38.26.C04.1.454.CMB.2.raw
  modified_base (373)..(373): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagtcgtgggtgcgacgacggccccctaggacaaagggtccttggaggtggagtgggggacgggtactcccgtcccgattcgtttacggaccaaaccncacctaccggcaaccactaacgttccacgggaacagacctacgacacttacggcgtaacatcccaacggtacgcacagtactacagtggagatagagtacgcgtagagtatcgtagacgaccgtacggcgttcgttaactttcgtagtggcggaaggacggggtacggggccggaagggggtcggttacggggttcgggtttaacggttgggttcggttcgtttttggagttacgttcggttaaggggtaacccgg

SEQ ID NO: 378312 - DNA, 647 bp, Homo sapiens
  misc_feature: GZ8MTXP01BG9HV.38.26.C04.1.454.CMB.2.raw
  modified_base (504)..(504): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgttattctgtgcgagagggagggggccgagggggcgtcgggtcggttaaacggttaggtgtcgttttgaatagtcggtgggggaccgaaagggactaaacggtggtaccgtaccgtcctcctcacggccctaccaccgaacgggccctagtccggtcccttcccccgtgtccctaccccctcgtacccgaagtcncccgaccgtcggtcggggcaacgtcggcccgggtcccgtcgggctcggcccgttaggggtaccaaagggtacccttaccgttacccgttaacggttcgtaacgttccggaacgttcggggacggccgggtcgttcgggaacgg

SEQ ID NO: 378313 - DNA, 725 bp, Homo sapiens
  misc_feature: GZ8MTXP01DPZWQ.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacgacggtacgtgctgttgtactgcctcctcccgattcgtttggaccaaaccacactacgcacacaacgttccaggacagactcacgtacttaccgcgaacgaactccaacgagccaacacgtctaacagtggagataggaagtacgccgtagagactcgacgaaccgacgaccggtcgttgttatttcgtggtcgacggaagggacggggacgggggccgagggggtcgttacggggttaacggttaacggtttaggtcgttacgttttagaaacttacgtcgggtacggggaacccgtaaagggaactaagtcggtacctacccgttcctccgtacgaccgtaccctacccgaaccggtaccgggccctacgttcccggtaccccttccccgcggacccctacccctaccgtaaccgaagtcccgtccgaccgttcgggacgggaccaaccggcggtccccggtcccgtcgggcctccggtccgttacgggtaccgaacggtaacccttcgttacccgcggttacgtaacgtccggaacgtcgggacggccggtcgcgggaacg

SEQ ID NO: 378314 - DNA, 742 bp, Homo sapiens
  misc_feature: GZ8MTXP01APETE.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctggtgacggtcccctgcgaaggcttcgtggacggccaccttcacgccacctatactttcagtcgtgggtgcgacacggccccgtggacgaagggtcttggagtggagtggggacggtactcccgtacccgtagttccgtttacggaacctaaacccgactaaccccgtaccggaccaaccgtaaccgtaacggttaacccgaaacgggtaaccaaacgtaacctaccgaaccgtaacgtaacccgggacggtaaccgaactcccgaacggacgaccaacgtacgtaccgtaaccgagtacgggaagtacgtagaacgtacgaccggtaggaacggtactaccgtaacggaacccgtacgtaccgggttaccgttagtttacgttccgtggtacggaacgggtaacgggacggggtacgggggccggtacgggggtacggttccggggttagggttaccgggtttaagggttcgtttccggtttaggtacgtttacggtccgggttaacggggtaaccggg

SEQ ID NO: 378315 - DNA, 759 bp, Homo sapiens
  misc_feature: GZ8MTXP01DECUV.38.26.C04.1.454.CMB.2.raw
tcagtcgatcacgtcacgaccggtgctcgatttagtctagcgactttgggtttggggatcacataacaaccacattccctcctctaaagaagcccctgggagcacagctcatcaccatggactggacctggaggttcctctttgtggtggcagcagctacaggtgtccagtcccaggtgctaggttggtgcgagtcgtggggctggaggtgaagaacgccgtgggtccgtggtcgaacggtcccctagacgaaggtcttcgtggagtcctacccttcacgtcctaaccttattactttcgagtcgtgggtcgaccgacgaccggccccgtaggaacgtaaacgggtctttaggaggtagggaggtagggggacgggtaccttaccccgttaccggagtttccggtttacgggaaccctaaaacccgaccgtaacccgtaacccggactaaaccgtaaccgtaaacggttacccgaagggaaccaaggtacctacgaacgtactaccggacggaaccaacgtccaacggacgacaacgtacgtactactagtagggaatagtacgtaacgtacgccgtagaaggtacttacgacggaacccgtaccggtacggttaccggtttattaccgttttggacgttcgggtaaccggaagggacggggtacgggggacccggttagggggtcccgttaggggttacggtttaaacgggtttggtacgtttgtttaggagttacggtcgttaacgggggtaaccgg

SEQ ID NO: 378316 - DNA, 679 bp, Homo sapiens
  misc_feature: GZ8MTXP01ED37D.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcgagtcgtggggctgaggtgaagagccgtgggtcctggtcgaacggtcccctgcaaggtcttcgtgggaggccaccttcagcaccttatactttcagtcgtagggtcgacgacgacggtcccccgtaggacgaagggtcgttaggaggtggacgtagggggacgggtactccccgtccgtagttcgtttacggaccaaaccaccaaccctaccgacacgaactaacgttaccgaacggaacacgacctaccgaacgtacgttaccggacgtaacgaactccgagacgcaacgacgtactacagtaggagatgagtacgtcgtagacgtactacgagaaccgacgtacggtccgtttagtacgtttcgtacggtggaacggtaagggacggggacgggggttaccggaggggtccgggttacggggttacgggttaacgggttgggttagttccgtttttaggacgttacggtcgggttaacggggtaaccgg

SEQ ID NO: 378317 - DNA, 835 bp, Homo sapiens
  misc_feature: GZ8MTXP01B30G6.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagccgtggtcctggtgaacggtccctgacaggtcttcgtggacggctaccttcagccacttatacttcgagtcgtggtcgacgacgacggccccgtggaacgaagggtcgttaggaggtaggggtaggtacgggggtacgggtaccgttccccgttacccggtacgtttaccgtttacggaaaccctaaaacccgaccgtaacccccgttaccggaccgtaaaccgtaaacccgtaaccggtttaacccgaaacgggtaaccgaaccgtaaccgtaccgaaccgtaaccggtttaaccccgggacgggtaaaccgtaaccgtaccgaaccggtacgacctaaccgtacgttaccgtaacgtagtacgggaagtaacgtacggtaaggttaccgtacgggtaggtaaacggtaccgttaccggtacggtaaacccggtaccggtaccgggttacccggtttagtttaaccgtttcggtacgggtagggaaccgggaaggggttacggggtaccggggggttaccggtacgggggtaccggtttacgggggttacgggtttaacggggtttcgggtaggtttaacgttttacggagtttaccgggtaacgggttaacggggtaaaccgg

SEQ ID NO: 378318 - DNA, 717 bp, Homo sapiens
  misc_feature: GZ8MTXP01AWCIQ.38.26.C04.1.454.CMB.2.raw
  modified_base (263)..(263): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctcggtgaacggtcccctgcaaggcttcgtggagctaccttnacgccaccttatactttcagtcgtgggtcgcgaccgacggccccgtaggaccgaagggtcttaggacgtgggaagtgggggaggtactccccgtcccggtattccgtttacggaaccaaacctaccgaacccgtaccgaccgtaaccaaaccgtaacggttaacccgaagggtaacccagaacccgtaccgtaaccgtaccgtaacccggacggaaaccaaacgtacccgaacggacgacctaacgtacgtaacgaacgtaaggtggaaagtacgtaggaagttaccgaccggtagaacgtactccgtagaaccgacgtaccggtcgtgttacttcgtcggcgaagggtacggagggggtacggggacccggagggggtacgttacgggggttagggttacggttaacgggtgttcggttttagacggttcgtccgggttaacggggtaaccgg

SEQ ID NO: 378319 - DNA, 735 bp, Homo sapiens
  misc_feature: GZ8MTXP01EDZO0.38.26.C04.1.454.CMB.2.raw
  modified_base (278)..(278): a, c, t, g, unknown or other
tcagtcgatcacgtcacgaccggtgctcgatttagtctagcgactttgggtttggggatcacataacaaccacattccctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtggtcctcggtgaacgtccctgcagctcgtgagcacctcagcactatacttcagcgtgggtncgacgcggccccgtaggacgaaggtcgtgaggtggagtggggaggctcccgtccgtatcttggacaaaccacaccacgacacaactaacgttaaccgagaacgacgtaacctcgaaccgtacgtacccggacggtaaaccgaactaccgaacgaacggaccaacgaacgttacgtaacctaagtagggaagtacgtaggtaagtacggacccgggtaagacgtaacgttaccgaggaaaccggaacccggtaccgggtaccccggtttacgtttaaggttttccggttacgggtggtaaaccggggaaggggaacgggggtaaccggggggaccgggtaacggggggtaccgggttcgggggtttaacggggttttaaaccggggtttaagggttacggttaaccgtttttaggaaccggtttagggttaacccggggtttcggggtaaaaccgggg

SEQ ID NO: 378320 - DNA, 752 bp, Homo sapiens
  misc_feature: GZ8MTXP01CX2MR.38.26.C04.1.454.CMB.2.raw
  modified_base (139)..(139): a, c, t, g, unknown or other
  modified_base (250)..(250): a, c, t, g, unknown or other
  modified_base (263)..(263): a, c, t, g, unknown or other
  modified_base (720)..(720): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctntttgtggtggcagcagctacaggtgtccagtcccaggtgcaggttggtgctagtcgtggggctggaggtgaagagcctgggtcctggtgaacggtccctgcgaggtcttgnggaggctaccttnacgcctacctatacttcagtcgtgggtcgcgacgaccggccccgtaggacgaagggtcgtaggaggtgggaggtagggggtacgggtaccttccccggttacccgtaagtttcccgtttacggaaacccaaaacccgtaccgtaacccccgtaaccggacctaaccgaaaccgtaaaccgttaacccgaacgggaacaaacgtacctaacggaaccgtaacgttacccggacggaaaccaaacgtcccgaacggacgacttaacgaacggtcaaacgagtagggaagagtaggaaacggtaactccgggtagtaaggtacacgtacggaaccgccgaccggggttaccttagttaaccgtcggttgagggaaccggtaaggggacgggtagggggcccgtaagggggtcgtttaccggggttaggtttaaccgggtttggtaggttcgttttaaggngtttaacggtcggggttaacgggtaaacccgg

SEQ ID NO: 378321 - DNA, 663 bp, Homo sapiens
  misc_feature: GZ8MTXP01CED8S.38.26.C04.1.454.CMB.2.raw
  modified_base (246)..(246): a, c, t, g, unknown or other
  modified_base (290)..(290): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatcttggcaaaccacactacgcacacaagttccaggacagactcacgattaccgngacgaatccacgagcacagtctacatggagatgagtagcctganatctgacgacacggccgtgttatttcgtgtgcgaggagggacgggggcagggggcgtcgggtacggtaacggttaggtgtctttgaattagtcggtggggcccgaaaggggacaagtcggtcacccgtctcctcacgcctaccgaccgacgggcccacgttccggtcccttcccccgtcggaccctaccccgttcccgtaacccgaacggaccgtacccgtaccccggttccggtccggggggacctaaccggaccgggtccccggggtccccggtcggggcccgtcggtcccggttcgggtacgaaacggtacccttacgttacccgcggttcgaacgtcgaacgtcggacgggcgggtcgttcgggaacgg

SEQ ID NO: 378322 - DNA, 671 bp, Homo sapiens
  misc_feature: GZ8MTXP01DU0DF.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtggtcctcggtgaacggtcccctgcaaggtcttcgtggagctaccttcagctactatacttcgagcgtggtcgcgacgacggtccccgtaggaccgaaagggtcgttaggaggtagggaggtcgggggaggtacgtcccgtacccgtattcgttacgaacctaaaccactaccctaccgacaacgaactaacgtaaccgaaggcaacgacctaccgaacgtacgttacccggacggtaaccgaactacccaacgaacgaccaacgtacgtactaacagtaggaagagtagaacgtacgcggtagaacggtataccggtagaaccgtacgtacggtaccgttagttacttcggtagtgggaaccggaagggaggggcggggacggtaggggtccgttaggggttagggttacggttaaggtggttaacgttaggacgttagtccgggttgggaaccgg

SEQ ID NO: 378323 - DNA, 640 bp, Homo sapiens
  misc_feature: GZ8MTXP01AMJM6.38.26.C04.1.454.CMB.2.raw
  modified_base (228)..(228): a, c, t, g, unknown or other
  modified_base (237)..(237): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagctgggtctggtgagtcccngcagcttcnggagcacttcagcacctatacttcagctgggtcgcgacgacggcccctggacaagggcttggaggtggagtggggagggtactcccgtcccgtattcgttcggacaaaccacacctacgcacacgaacgtaccaggaacacgaccacgacgacttaccggacggtaaccgaactacccgaacggacgaccaacgtacgtactaacgagtcgggaagtagtagagtacgccgtagagtactcgtagaaccgacgaaccggtccgttgtacgttccgtaggccgcggaagggacgggacgggggacccggtaagggggtcggttacggggttagggttaaaccgggtttgggtaggtttaaccgttttggaacgtttacggtaacccggttgggggtaaacccgg

SEQ ID NO: 378324 - DNA, 660 bp, Homo sapiens
  misc_feature: GZ8MTXP01BX100.38.26.C04.1.454.CMB.2.raw
  modified_base (242)..(242): a, c, t, g, unknown or other
  modified_base (555)..(555): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcgtggtcctggtgagtcccctgcaggcttcgnggagcaccttcagcacctatacttcagcgtgggtcgcgacgacggccccgtggacaagggtcttggaggtggagtgggggacggactccccgtccgtaacgttcgtttacggaccaaaccaccgtaacccgtaccgaccaacgaacctaacggttacccgaagggaactacgaccctacaaccgtacgttaacccgggacggaaacgtaacgtcccgaaggacgacaaccgtacggttactaacgagtacggagaacgtggagtaacgccgtagagtactcgtagaccgacgacgggtccttagtactttcgnggtggccggagggttacggggacgggggcccgtagggggtcgttacggggttgttaaccgggtttgggtcgttcgttttgagttacgtcgggttcggggaaccgg

SEQ ID NO: 378325 - DNA, 664 bp, Homo sapiens
  misc_feature: GZ8MTXP01A68BZ.38.26.C04.1.454.CMB.2.raw
  modified_base (322)..(322): a, c, t, g, unknown or other
  modified_base (536)..(536): a, c, t, g, unknown or other
  modified_base (579)..(579): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcgacgaatccacgagcaacagtctacagtggagatgagtagcctgagatcgagacgacgaccggcgttgtatttcgnggtgacggaggacgggtacggggggcccgagggggtctcggggtacggttaacggtttaggggtcgttacgtttttggaaattacggttccgggtacggggggaacccgtaaagggggtaacctaaaggttcggggtacctacccgtccgtcctacgacgtccctacccgaaccgaacgggcccctagtccccgttcctcccccgtaggtcccnccccgtacctccgaagccgacctaccgtcggtcgggcaaccgngtcccggtcccgtgggcgtcgccgttggtacaggtacctacttcgacgttcgctccgaagtcggacggccggtcgttgggaaccg

SEQ ID NO: 378326 - DNA, 612 bp, Homo sapiens
  misc_feature: GZ8MTXP01BTKL9.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctagagatcgtgacgacaccggtcgttgtatttcgtagtgacgaggagggacgggggcgaggggcgtgggtacggtaacggttaggtgtcttttgaattacgtcggtgggacgaagggactaagtggtcaccgtctctcacgccctccgaccgacggcctacgtccgtccttccccgtcggccctacccctccgtacgaacgaccgaccgacccgtcgtcgggggccaccgacggcccggccgtcgggccgtcgtcgttcggtacaacggtcctaccgttccgacggttcgaacgtcgaacgtggacggcgggtcgttggaacgg

SEQ ID NO: 378327 - DNA, 668 bp, Homo sapiens
  misc_feature: GZ8MTXP01C71G1.38.26.C04.1.454.CMB.2.raw
  modified_base (284)..(284): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagctgggtcctggtgaacggtcccctgcaaggtcttcgtggagcaccttcagctactatacttcagcgtggtcncgacgcggccccgtaggacgaggtcttaggaggtggagtgggacggtactccccgtccgagttcgttacggacctaaacacctaaccctaccggacaacctaacgtaacgtaacccgagggaacacgtacctacgacgtacgtaccggacgaacgtaactccgacgacgctaaccgagtacctaacgtagtacggaagtaagtggtaaacgtaccggtacgtaggtaagacttacggtacgacccgacgtaccgggttccttagttagttcgtaggtcggaacggaagggttcggggacggggccggaaggggtcgttacggggttagggttacggttaagggtgttaacgtttaggagttacggtcgggttaacgggtaacgg

SEQ ID NO: 378328 - DNA, 729 bp, Homo sapiens
  misc_feature: GZ8MTXP01EZK1H.38.26.C04.1.454.CMB.2.raw
  modified_base (187)..(187): a, c, t, g, unknown or other
  modified_base (345)..(345): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtncagtctggggctgaggtgaagagctggtcctggtgacgtccctgcagcttctggagctacttcagcacctatacttcagctggtgcgacgacggccccctggacgaaggctttgagtggatgggggaggtatcccgtcgattcgttcggaccaaaccnctacccctacgacgacaacgtaacgttacccaagggtaaccacgtaaccgtaccgtaacggtaaccgtttaacccgggaccggaaaccggtaaccttacccgaacggtaacggaccaacgaccggttactaaccgtaagttacgggaagacgtacgtaagggttacgaccggtttagaaggtaccttacgtaaccggaaccgtaccgacgggttaccccggttgtttaacgtttcgtgggtcggaacgggtaacggttaagggggaccgggggttacccggtagggggccccggttaacggggtttagggttaaccgggttttaagggtaggtttccgttttagggggacttaacgggttccgggttaacgggggtaaacccgg

SEQ ID NO: 378329 - DNA, 720 bp, Homo sapiens
  misc_feature: GZ8MTXP01AGP4Z.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcgtgggtctcggtgacggtcccctgcaaggcttcgtggacggcaccttcagcacctatactttcagtcgtgggtgcgacgaggcccccgtggacaagggtcttggagtggacgtgggaggtatcccgtcccgtatcgtttggaccaaacgaccaacccgtacgcgaaccaaccaaggttacccaagggaaccacgacctaccgacgtacttaaccggcggaacgaactcgaacgtagaccgacacgttacactagtaggagtactaggaagtacgacgtaggaagacgtacgtcggaaaccgaccgtaccggtaccggttagttaacgttttccgtaggttcgggaaccgggtaagggagggggaaaccgggggttccggtaaacggggggttccgttaccggggggttacccgggtttaaacgggggtttaagggggtttccggtttaaccggtttttacggaaaggtttccggggtttcgggttaacggggggtaaaaccccgggg

SEQ ID NO: 378330 - DNA, 720 bp, Homo sapiens
  misc_feature: GZ8MTXP01EO444.38.26.C04.1.454.CMB.2.raw
  modified_base (709)..(709): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagccgtggtcctcggtgagtccctgcaggcttcgtggacggctaccttcagcctacctatacttcgagtcgtgggtgccgacgacggcccccgtgggacgaagggtcttggaggtggagtagggggagggtactcccgttacccggtagttcgtttacggaccaaacccgacctaacccgtaccgacacgaaccgtaacgttaacccgaacggtaacacgtacctaccgaaccgtaacgttaacccgggacggaaaccgaactaccgaacgacgaccaaccgtagttaccgaaaccgtaggacggaagtacgtaggtaacgtacgacccgggttaggacggtacgttaccgaggtaaacccggaccgtacccgggttccgttagtttacgtttccgtggtcggaacggtagggacggggacgggggaccgtgggggtccgttacggggttcggtttaaccgggtttggttagtttggttttacggacgttaggttccgggnggggtaaccgg

SEQ ID NO: 378331 - DNA, 672 bp, Homo sapiens
  misc_feature: GZ8MTXP01D86ZZ.38.26.C04.1.454.CMB.2.raw
  modified_base (425)..(425): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtagaagagccgtgggtcctcggtagaacggtcccctgacgagtcttcgtggacgctaccgttcacgtctaccttatacttcagtcgtggtcgacgacgacggtccccgtaggacgaaggtcttggaggtggaggtagggaggtactcccgtacgtattcgttacgaaccaaaccgctaacccgtaccgacaacgtaacctaacggtacccgaagggaacncgtaacctacgacgtacgtaccggacggaacaactccgaacgacgcacgtacgtactacgagtaggagacgtagtaagtacgtcgtaaggacgtagttccgaacggaccgaccgtacggtaccgttagttacgttcgtaggtcggaacggtagggacggggacggggttacggtacggggtcggttaccgggttagggttaccgggttgttacgttgtttagacgttagttcgggttaacggaacgg

SEQ ID NO: 378332 - DNA, 787 bp, Homo sapiens
  misc_feature: GZ8MTXP01DU4U0.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcaacagtctacatggagatgagtacgcctgagtatctagaaccgacgacggtccgttagttactttcgtggtggacggaaggaggggtacgggggccgagggggtcgttaccggggtaggttaacggtttagggttgttcgtttttaggaaagttacgtcgggtacgggggacccaaaggggtaacctaacggttcgggtaccgtaccccggttccttacccgttacgaccgtccccgttacccgaaacccgggtaaaccggggtccccctaacgtttccccgggttccccctttccccccggtcgggtacccctaaccccccgttccgtaacccgaaacggtccgtacccgaacccgtttcgggacgggggaccctaaaccggccgggcccgggtaccccggtggggtcccgttccggtcccgggttcgggtaaaccgttaaacgggttacccttacccggttacccgacggttacgtccgtacggtaaccggttgggaccgggcggggttcgcgggaaccggg

SEQ ID NO: 378333 - DNA, 765 bp, Homo sapiens
  misc_feature: GZ8MTXP01AW8Q7.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggtcttcgtggaggcaccttcagcacctatactttcagcgtggtgcgtacgacggcccctaggacgaagggtcttggagtgggagtgggggaggactcccgtccgtagttctttcggaacctaaacccactaacccgtaccgacactaaccgaacgttacccaagggaaccagactacacgtactaccggacggtacaactccaacggagccaacgacgttaccacgtaagtcggaagtagtaggaacggttacgccggttaggaacgtaacgttcgtaacggaacccgtaccggtaaaccgggtccggtttacgttacgttttaccgggtggttaacgggtaaccgggtaaaggggaaccgggggtaccggggggggccccggtaaaggggggtacccgggtttaccggggggtttaaagggggttttaaaacccggggttttgggggttaacccgggtttcgtttttaagggaccggttttaacggttcccgggggtttaacgggggtaaaaccccggggg

SEQ ID NO: 378334 - DNA, 715 bp, Homo sapiens
  misc_feature: GZ8MTXP01DEKCM.38.26.C04.1.454.CMB.2.raw
  modified_base (255)..(255): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagcctggtcctcggtgacgtccctgcagctcgtggacgctaccttnagcaccttatacttcgagcgtgggtcgacgacgacggtccccgtaggacgaagggtcttagaggtcgggaagttgggggacgggtacttccccgtccgatttcgtttacgaccaaaaccgtacctaaccgtaccgacaacgaacctaacgttaacccgaagaaccagtaccctaccgacgtaacttaccggacgggaacaacgtacccgaacgaacgaccaacgtacgtacctaacgagtaggaacgtagtaggaagtacgaccggtagaggtactccgtaaggacccgtaccggtacggtccgttagttacgtttcgcggtggaacgggtaaggaacgggggcgggggttacccgtagggggttacccggttacggggtttacgggttaaacgggtttgggttacggtttaacgttttaggtacggttaacggttccggggttaacgggggtaaaccgg

SEQ ID NO: 378335 - DNA, 702 bp, Homo sapiens
  misc_feature: GZ8MTXP01APMVR.38.26.C04.1.454.CMB.2.raw
  modified_base (578)..(578): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcatcagctacaggtgtccagtcccaggtgcagttggtgcagtcgtgggctgaggtgaagagccgtgggtcctggtgaacggtcccctgcaaggcttcgtggagcctaccttcagcactatactttcagctgggtgcgacacggccccgtggacgaagggtcttaggaggttgggagtcgggggacgggtactcccgtcccggtattccgtttacggaccaaacccgactaaccccgtaccgacaaccgacaaacggttcccaagggaacacgactaccgacgtacgtaccggacggaacgaaactcccgaacgagtaccaactacggtacctaacgagtagggaagtaagttaggaacgtaacgcccgttaggaacgtatacgtacggaaccgaccgaccgggtacccgttagttactttccgttgggngaaccgggaagggaaggggacccgggggttcggtaaggggggtcccgttggggttacgggttaaaccgggtttgggtacggttcgttttaggagtttacggtcgggttaacggggtaaaccggg

SEQ ID NO: 378336 - DNA, 702 bp, Homo sapiens
  misc_feature: GZ8MTXP01CC2OC.38.26.C04.1.454.CMB.2.raw
  modified_base (247)..(247): a, c, t, g, unknown or other
  modified_base (607)..(607): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaagtcttcnggagctaccgttcagccactatactttcagtcgtggtcgacgacgacggccccgtaggacgaaacgggctttacggagtgggacgtggggtaacgggacttcccggtacccgtaagttccgtttttcgggaccaaaacccgaacctaaccccgttaaccgacaaccgaaaccgtaaacgttaacccgaacggaacaacgacgttaccaacgtacgttacccggacgggtaaaccgaactaccgaacgacgaccgaaccgtacgttacgtaaccagttcgggaagtaagtacgggaacgttaacgccggttaggagtacgtacgtacgaacccgacgaccggtacgtgttattcgtgtcgnggtacggaggtcgggggacgtacgggggtcgttacggggttcggttaccggttaagggtcgttcgtttagattacggttcgttcggggtaaccgg

SEQ ID NO: 378337 - DNA, 606 bp, Homo sapiens
  misc_feature: GZ8MTXP01EH9IH.38.26.C04.1.454.CMB.2.raw
  modified_base (430)..(430): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtccctgcaaggcttcgtggaggcaccttcagcacctatactttcagcgtgggtgcgacacggcccctggacaagggcttggaggtggagtggggaggactccgtccgattctttggaccaaaccacactacgccacacaagtccaggaacagctcaacgacttaccgacgaacgaatcccaacgagacacagtactacagtgganatgagtagacctgaggtatcgtagaaccgacgaccggtcgttagttacttcgtggtacgcggaaggaagggcgggggccgaagggggttccgttacggggtagggttaaacggtttggggttcgttggtttagaagtttacggtcggttacggggtaacccgttaaggggtaaccg

SEQ ID NO: 378338 - DNA, 610 bp, Homo sapiens
  misc_feature: GZ8MTXP01DMRD4.38.26.C04.1.454.CMB.2.raw
  modified_base (277)..(277): a, c, t, g, unknown or other
  modified_base (318)..(318): a, c, t, g, unknown or other
  modified_base (454)..(454): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccagagcacagtctacatgganatgagtagcctgagatctgacgacacggccgttgtatttcngtgcgagaggagggggcaggggctcggtacggtacgttaggtgtcttttagaattgtcggtaggggaccaaaggggacaagtcggtacaccgtctctcacgcctaccaccgacggcctacgtccgtccttccccgnggccctaccccgtccgtaccgaacgtcgaccgtaccgtccggtcgggggaccaccgcggcccggtcccgtcgggccgtcggtccgttggtaccgaacggtacctaccgttccgacgttcgaacgtcgaacgtcggacggttcgggcgttcggaacg

SEQ ID NO: 378339 - DNA, 776 bp, Homo sapiens
  misc_feature: GZ8MTXP01B1TWI.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtggtcctggtgaacggtcccctgcgaggtcttcgtggacggctaccttcagacctaccttattacctttcagtcgttgggtcgaccgaaccgaccgggtccccccgtagggaaccgtaaacggggtccgttaggtagggtagggtaggttcgggggaacggggtaccgttcccccgttacccggtaacgtttccggttttaccgggaaccctaaaaacccctaccgtaacccctaaacccggccaaacccgtaaaccgtaaaccgtttaacccgaaacgggaaccaacggtaacccttacccgaaacgtaaccgttaacccgggaccgggaaaccgtaaccgttacccgaacggaacgaccaactacgtaccgtactagtaggagtagtagaagtacgacggtagagtacgttacgcggaaccgaaccgccggttcgttacgttagtttccgtggtcggaaccgtaagggagggtcgggggccgtaggggtccgttgggttacgggttaccggttaaggttcggtcgttttaggacttacggttcgggcgggtaaaccggg

SEQ ID NO: 378340 - DNA, 620 bp, Homo sapiens
  misc_feature: GZ8MTXP01BMD46.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgagtgaagagctgggtcctggtgaacgtccctgcaggcttcgtggacgctaccttcagcacctatacttcagcgtgggtgcgacgacggcccctggacgaagggtcttggagtggagtggggacggactcccgtccgtatcgtttcggacctaaaccacaccctaccgacacacaacgttacccaggaacacgacctacacgtacgtaccgcggtaaacgaactccgaacggacgccgaacacgtacgtaacagtggaagtagtacgagttaacgccgttagagtactcgagaccgtacgacggtccgtcgtatttcgcgcggaacggaggacggggcggggcccgtagggggtccgttacggggttggttacgggttaacggttcgttcgttttaggagttacgtcggttcggggaaccg

SEQ ID NO: 378341 - DNA, 626 bp, Homo sapiens
  misc_feature: GZ8MTXP01BNSHT.38.26.C04.1.454.CMB.2.raw
  modified_base (247)..(247): a, c, t, g, unknown or other
  modified_base (343)..(343): a, c, t, g, unknown or other
  modified_base (465)..(465): a, c, t, g, unknown or other
  modified_base (532)..(532): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctcggtgaacggtcccctgcagcttgnggagcaccttcagccacctatacttcagcgtgggtgcgacgcggcccctggacaagggtcttggagtggagtggggagggtactcccgtacccgtnttcgtttacggacctaaaccaccaacccgtacgacaaccacgtaacgtacccgagtaacacgaccttacgacgtaccgttaccgacggacgaactcccgaacggacgacacgagtaccaagntaggagtagtaggtagtacggcgtgaacgtatcgtacggacgaccgaacggtcccgtgttatttcgnggttgcggagggagggtacgggggccgtagggggcttcgggggttaggttacggtggttcgtcgttttgagttacgtcgttaagggggaacccg

SEQ ID NO: 378342 - DNA, 688 bp, Homo sapiens
  misc_feature: GZ8MTXP01COV6G.38.26.C04.1.454.CMB.2.raw
  modified_base (257)..(257): a, c, t, g, unknown or other
  modified_base (479)..(479): a, c, t, g, unknown or other
  modified_base (486)..(486): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctggtgaacggtcccctgcaaggcttcgtggagctacttnagcactatacttcagctgggtgacgtacgacggcccctaggacgaagggtcttaggaggtgggagtgggggaggtaccgttcccgtcccgtagttccgtttacggaaccaaacccgactaccccgtaaccgacgaacaaccgtaaacgtttaacccgaaggaaccagacccttacgaacgacttaaccggcggaacactcgacgacgcaacgtagtcgaacngtagganagtaggagtaacggctagaggtactcgacgaacgtaccgtcggaccgttgttaacgttcgtacggtcgggaacgggtaagggaccgggggtaaacggggggttcccgtaaacggggggtccgttacgggggttacggttaacggggtttggttacggttgtttaacgggagttaccggtcggggttaacgggggtaaaccgg

SEQ ID NO: 378343 - DNA, 694 bp, Homo sapiens
  misc_feature: GZ8MTXP01CW5NJ.38.26.C04.1.454.CMB.2.raw
  modified_base (285)..(285): a, c, t, g, unknown or other
  modified_base (571)..(571): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcggtgaacggtcccctgcaaggcttcgtggagctaccttcagcactatacttcagcgtggtncgacgcggcccctggacgaagggcttaggaggtggagtgggggacggtacgtccccgtcccgtatttcgttacggaccaaacccgaccaacccgtaccggcacaacctaacgttaacccgaggaaccaacgaccctacgaaccgtacgtacccggacgggaaccaacgtacccaacggacgaccaaaccgtacgtaacttaacaggtaggaacgtagtacgaaggtaccgaccggtaggaacgtatccgtacggaccgtaccgaccgggtccgttgttactttcgnggtcggaacggtagggacgggggtacggggcccggtaagggggtcgttaccggggttggttaaccgggtttggggttcgtttccggtttaggacgttacgggttcgggcgggggtaaacccgg

SEQ ID NO: 378344 - DNA, 616 bp, Homo sapiens
  misc_feature: GZ8MTXP01C94FV.38.26.C04.1.454.CMB.2.raw
  modified_base (207)..(207): a, c, t, g, unknown or other
  modified_base (294)..(294): a, c, t, g, unknown or other
  modified_base (315)..(315): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaaccncactacgcacacaagttccaggacagactcacgattaccgcgacaatccagagcacagtctacatggagatgagtagcctgagatcngacgacacggcgtgtatttcngtgcgagaggagggggccaggggctcggtggtaacgttggtgtcttttaggaattagtcgtggggacccaaaggggacaagtgggtactacccgtctcctcgtacgcctaccgaccgaacgggccctacgtccggtccttccccgtggaccctaacccgtcctaccgaacgacgaccaccgtcgtcggggaccacgacgtccgggccgtcgggccgtcggcccgttgggtacgaaacggtactaccgtttaccgcgttcgtaagttaccgaacgttcggacggcgggtcgttcgggaaccg

SEQ ID NO: 378345 - DNA, 684 bp, Homo sapiens
  misc_feature: GZ8MTXP01AI8VW.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctggtgaacggtcccctgccaaggcttcgtgggaggctaccttcagccacctatacttcagctgggtgcgacgacggccccgtggacgagggcttgaggtggagtgggggagggctcccgtcccgtattccgttaggaccaaaccgacaccctacgcaacgactaacgttccaaggaaccagacctacacgtacttaccgacgaacgaactccaacgacgacaacgagtaacctaacgacgtaggaacgagtacggtaacgtacgccggttaggaacgtacgtaccgtacggaaccgaccggaccggttccggttagttacgtttccgtgtcgggaacggtaaagggcgggggtaacgggggccggtacggggggtacgttacgggggttccgggtttaaagggttcgggttggttcgttttagggacgtttacggttaacgggttaaccgggggtaaccggg

SEQ ID NO: 378346 - DNA, 662 bp, Homo sapiens
  misc_feature: GZ8MTXP01ASUAB.38.26.C04.1.454.CMB.2.raw
  modified_base (205)..(205): a, c, t, g, unknown or other
  modified_base (246)..(246): a, c, t, g, unknown or other
  modified_base (275)..(275): a, c, t, g, unknown or other
  modified_base (288)..(288): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccncactacgcacacaagttccaggacagactcacgattaccgngacgaatccagagcacagtctacatgganatgagtagctgantctgacgacacggtccgttgttactttcgtgtcggacggaggagggtacgggggccgagggggtccgttcggggttaggttaacggtttaggtcgttacttttaggaaacttacgtcggtagggggtacccaaaggggactaaggtcgggtactacccgttctcctacgacgtccctaccgaacgaacgggtccctacgttccggtacccttccccgaggtaccctaccccgtcctacgaacggccgaccctaccgtcggcggggaccaacggcggccccggtccggtcgggcgtcgccgttacggtaccgaaacggtaccttacgttcccgagttcgaacttcggaaccgtggacggttcggcgttcggaacg

SEQ ID NO: 378347 - DNA, 634 bp, Homo sapiens
  misc_feature: GZ8MTXP01BEF6W.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtggtctcggtgacggtcccctgcaaggcttcgtggacggctaccttcacgccaccttatactttcagtcgtgggtcgcgacgacggtccccgtaggaccgagggtcttaggaggtggaggtggggacggtactcccgtccgtattccgttacgacaaaccacacctacgcacacacgtccaacggaacacgactacgacgacttaccggacgaactacctacgacgacgacacagtacacgagtaggagagtagagtacgcgtagacgacttcgagaccgccgacggtccgtgttacgttcgtggtacggcggtagggacgggcgggggaccggaagggggtccggttagggttaccggggtttaggttcgggtttacgtttgttttaggactttacgggtcgttaagggggaacccgg

SEQ ID NO: 378348 - DNA, 658 bp, Homo sapiens
  misc_feature: GZ8MTXP01A91U2.38.26.C04.1.454.CMB.2.raw
  modified_base (634)..(634): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctgggtcctcggtgaacggtcccctgcaaggtcttcgtggacggctaccttcagccaccttatactttcacgcgtgggtcgccgacgccggccccgtaggacgtaagggcttggaggttggagtgggggaggtctaccccgttcccgtagttcgtttacggacctaaaccgactaccccgtacgacaaccaacgtaacgttaccgaaggaaccacggactaccaagtaccttacggacgaacgactaccgaacgacgcaacgacgttaccgaactgtacggaagacgtaggacgtacgccgtagacgtactcgtacgacgaaccgtcggtaccgttagttacttcgtgtcggaacggaggttacggggacgggttcggacggggtcgttcggggttggttaacggttggtgtttcttaggngttacgtcgggttaacgggaaccg

SEQ ID NO: 378349 - DNA, 607 bp, Homo sapiens
  misc_feature: GZ8MTXP01DFARD.38.26.C04.1.454.CMB.2.raw
  modified_base (258)..(258): a, c, t, g, unknown or other
  modified_base (386)..(386): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagagctgggtcctggtgaaggtcccctgcaaggtcttcgtggagcaccttnagcacctatacttcagcgtggtgcgacacggcccctaggacaagggtcttgagtggatggggaggactcccgtccgattcgtttacggaccaaacctacaccctacgacacacaacgttcccaagcanactacacgactaccgcgtaacgaactccgacgacgacaacgacgtactaacgagtaggaagacgtagacgtaacgccggtaggacgtactacgtagaccgaccgacggtcccgtgttacttcgtgtcgcggacggagggacggggccggaaggggtcggttacgggttaggttacgggtttaaggtcgtcgttttagagttacgtcgggttcgggtaacgg

SEQ ID NO: 378350 - DNA, 698 bp, Homo sapiens
  misc_feature: GZ8MTXP01BIVN8.38.26.C04.1.454.CMB.2.raw
  modified_base (316)..(316): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgataccgcgacaatccacgagcacagtctacatggagatgagtagcctgagatctgacgacacggccgtgtatttcgnggtcgcgaggagggacgggggcgagggggcgtcgggttacggttaacggtttaggtgtcgtttttaggaagttagtcgtacgggggaccgaaaggggtaaccgtaagttcgggtaccgtacccgtcctcccgtaccgacggcccctacccgaacccgtaaacgggcccctacgttccccggttcccgttcccccccgtacggccctacccccgtcccgtacccgaaacgtacgtcccgtacccgtcggcgggggcccaaccggcggcccgggtcccgtcggggcttccggccgttacgggtaccgaaacgggtacccctaacttcccgcgttacgtaacgtcggtaaccgtgggcggcggggtaaccgttcgggaacccggg

SEQ ID NO: 378351 - DNA, 682 bp, Homo sapiens
  misc_feature: GZ8MTXP01A6UPM.38.26.C04.1.454.CMB.2.raw
  modified_base (262)..(262): a, c, t, g, unknown or other
  modified_base (440)..(440): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttctctttgtggtggcagcagctacaggtgtccagtcccaggtgcagttggtgcagttcgtgggctgaggtgaagaagcctgggtcctcggtgaacggtcccctgcaaggcttcgtggacgctaccttnagactacctatactttcacgtcgtgggtcgcgacgaccggccccgtaggacgtagggtcttggagtggagtcggggaggtctccgtcccgtattcgttggacctaaaccacacccctacgacaacacgtaacgtccgaacggaacacgactcacgtacgttaccggacgtaacgaacnccgaacgacgacactagtcaactagaggagattaggacgtacgtcggagtagtaccgttcgacggtaccggaacgtcccgggttaaccttgttaaccggtttgttacgggacccggtaagggacgggacgggggccggggttaacgggtcgggggtacccgttagggggttaacggtttaccggggttaagttacggttccggtttaaggacggttaccgtcgggttaacggggaacccggg

SEQ ID NO: 378352 - DNA, 671 bp, Homo sapiens
  misc_feature: GZ8MTXP01ARWUB.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagccgtgggtcctcggtgaacggtcccctgcgaaggtcttcgtggaggcaccttcacgccaccttatactttcagctgggtcgcgacacggccccgtggacaaagggcttgaggtggagtgggggaggactccgccgtatcgttacggacaaaccacacctacgacacactaacgtccaaggcacgctacaacggacttaccgggagaaacccgaatacccgaagacgccgaacgacgttacaacgagttacgggaagaacgtaggaacgttacgaccggtaggaaggtactacccgtaggaacccgacgtaaccggggtccgtttagttaaccgttcggtagggtcgcgggtaagggacgggggacgggggccggagggggtcttcgggggttagggtttaaaccgggtttgggtccgtttaagtttggacgttaacggttcggttaacggggaaaccgggg

SEQ ID NO: 378353 - DNA, 674 bp, Homo sapiens
  misc_feature: GZ8MTXP01A5B43.38.26.C04.1.454.CMB.2.raw
  modified_base (256)..(256): a, c, t, g, unknown or other
  modified_base (292)..(292): a, c, t, g, unknown or other
  modified_base (403)..(403): a, c, t, g, unknown or other
  modified_base (555)..(555): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtagaagaagccgtgggtcctcgggtgaacggtcccctgcgaaggtcttcgnggagccaccttcagcacctatacttcagcgtgggtncgacgacggcccctggacagggcttgaggtggagtgggagggtactccgtccgtattcgttacggacctaaaccacacctacgacacactacgtacccaggaacacgaccncgacgtacgtacgacggtaaccgactaccgacgacgactaactaggtacctacgagtagggaacgtagtacggaacgtacgtccgtaggtaagtacgttaccgacggtaacccgaccggtacccggtaccggtttagttaaccgtttccggnggttacggaacggtaacgggacgggggtacggggaccggtacgggggtcgttaccggggttagggttaccgggtttggtcgttaacgttttggaacgttcggttcggaacggggtaacg

SEQ ID NO: 378354 - DNA, 629 bp, Homo sapiens
  misc_feature: GZ8MTXP01A3UWY.38.26.C04.1.454.CMB.2.raw
  modified_base (535)..(535): a, c, t, g, unknown or other
  modified_base (544)..(544): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagcctgggtcctcggtgaacggtcccctgcaaggcttcgtggagtcacttcagctacctatactttcagtcgtgggtgcgacacggcccctggaacgaggtcttggacggtggaggttggggaggctcccgtccgtattccgtttaggaccaaaccgtctaaccctaccggacaacgaacgtaaacgttacccgaagggaactacgactaccgtaacgtaccgttaaccggcgaaacgaacgtcccgaacggacgtaccaacacggttaccaacgacgtaggacgttagtagagtacgtctagacgatcgacgacgcgacggtntgtattcgnggtgaacgtggaggaggggccagggggtcttacgggttggttaacggttggttgttcgttttgacgttgtccggttggggaaccg

SEQ ID NO: 378355 - DNA, 821 bp, Homo sapiens
  misc_feature: GZ8MTXP01DPOCZ.38.26.C04.1.454.CMB.2.raw
  modified_base (262)..(262): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctggaggtgaagagccgtggtcctggtagaacggtccctgcaaggtcttcgtggacgctaccttnagtcactatacttcaggcgtggtgacgtaccgacggtccccgtaggaccgaagggtcttaggtacggtgggtaaggtcgggggacggtaccgttccccgttccccggtagtttaccgtttaccggaaacccaaacccggtaacctaaccccgtacccggaccaaacccgtaaacccggttaaaccggttaaacccgaaaggggaacccaacgggtaacccctttaaccgggaaacccggtaccgttaaccccgggaacgggaaacccgttaaaccgtacccggaaacggaccgaacccgtaaaccgtaacgtttacccgttaaagagggttaaaccgggacgttaaacgtagggtaaacgtacggtaccggttaaggaacggtacctttaacgggacgtaaacccgggaccgtacccggttaccggtttagttaccgtttaccgggcggacggcgggtaacgggacggggacggggttacggtacggggtacgttacggggttacgttacgggttgtacgtttcggttagtacgttacgggtcgggttaacgggtaacg

SEQ ID NO: 378356 - DNA, 691 bp, Homo sapiens
  misc_feature: GZ8MTXP01AEUU6.38.26.C04.1.454.CMB.2.raw
  modified_base (276)..(276): a, c, t, g, unknown or other
  modified_base (292)..(292): a, c, t, g, unknown or other
  modified_base (380)..(380): a, c, t, g, unknown or other
  modified_base (445)..(445): a, c, t, g, unknown or other
  modified_base (682)..(682): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccagagcacagtctacatgganatgagtacgcctaganatctgacgacgacggccgttgttatttctggtgcggaaggagggtacgggggccagggggcgttacgggtaggttaacggttagggtnttcgttttagaattacgtcggtcggggaccaaaggggactaagtcgggtaccacccgtcgttccncgaacgccctaccgaaccgaaccgggcccctaacggttcccggtccccttcccccgtacggacccctaaccccttcccggtaacccaaacggcccgtacccgtaacccgttcgggccgggggaccaccggacggtccccggcccggtcgggtcctcggtcccggttcggtaaccgaacgggtaccttaccgttccgttacggttctaacgtcccgaagtcggacggttcgggtccgngggaaccgg

SEQ ID NO: 378357 - DNA, 737 bp, Homo sapiens
  misc_feature: GZ8MTXP01BL23F.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaacgcgtgggtcctggtgaacggtcccctgcaaggtcttcgtggagctaccttcagcctaccgtattactttcagcgtgggtcgcgaacgcggccccgtaggaacgagggtcttggaggtggtagtggggacggtactcccgtccgtagttcgttacggaccaaacactaccctacgacactaactaacgtacccaaggaacacgtacctacgaaccgtaacgttacccggacgggaactaaccgtaccgaacggacgaccaaccgagttaccctaagaaggtacggagtaacgtggtaaacgtacgtaccgggtaggaacgttacgtcggtaacggaaccgaccgggtaccggttacccggttagtttacgttacgttcgggacggtaaccggaaggggacgggggtaccggggggccggtaaacgggggtcccgggttaacggggttacggggtttaaaccggtttggggtacgtttaacggttttggaacgtttaccggtccgggttaacgggggtaaaccggg

SEQ ID NO: 378358 - DNA, 772 bp, Homo sapiens
  misc_feature: GZ8MTXP01EO9JC.38.26.C04.1.454.CMB.2.raw
  modified_base (291)..(291): a, c, t, g, unknown or other
  modified_base (382)..(382): a, c, t, g, unknown or other
  modified_base (452)..(452): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcaggttggtgcagtcgtggggctgaggtgaagacgccgtgggtcctcgggtagaacggtccctgacgaaggtccttcgtggacgcctaccttcagacctaccttattactttnaggctgggtcgacgacgcggccccgtaggacgagggtcttggagtcgggagtggggaggtactcccgtccgtattcgttacgaccaaaccncacctacgcaacactacgtaccagtaacacgtactacacgtacgttaccggcggtaacactaccgagacnccgaactgtacctaacgagtaggaacgtagtacggtagtaccgtaccggtagggtaaacgtacttacggtaacggaacccgtaccggtacccgggtaacccggttttaggttaccgtttttaccggtagggttacgggtaacggggtaaacggggaacggggggtcccggggggttaaccccgggtaggggggttaaccccgggtttaggggggtttaacggggtttaaaaccgggttttggggttacccggtttttaacggttttaaggtaacgggtttacgggtttccccgggggttaaagggggttaaaccccgggg

SEQ ID NO: 378359 - DNA, 625 bp, Homo sapiens
  misc_feature: GZ8MTXP01DY5LZ.38.26.C04.1.454.CMB.2.raw
  modified_base (272)..(272): a, c, t, g, unknown or other
  modified_base (491)..(491): a, c, t, g, unknown or other
  modified_base (610)..(610): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgattctttggcaaaccacactacgcacacagttccaggacagactcacgattaccgcgaacaactccacgagcacagtctanagtggagatggagtagcctagatatcgtgacgacgacggtcgttagtatttgtgtgaggaaggagggacgggggtcgagggggtcgtgggttacggttaacggttaggtcgttcgtttgtaatacgtcgggtcggggaacgaagggaactaagtcggtacctaccgtcctccgactacggcccttaccgaacgacggtccacgtccgtaccctccccgngaccctaccccgcgtacagtaccgccctaccgtcggtacggcctacgccggtccggcccgtggccgtaacggtcgttcgtaacgacgtacctcgcttacggttcgaatccgaagtcggngaccggtgcggaacg

SEQ ID NO: 378360 - DNA, 573 bp, Homo sapiens
  misc_feature: GZ8MTXP01EXDG8.38.26.C04.1.454.CMB.2.raw
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttcngtgcgagagagggggccaggggctcggtggtaacgttaggtgtcttttgaattatcgtggggaccaaaggggacaagtgggtcaccgtctcctcacgcctccgaccgaacgggcccaacgtccggtaccttcccctcggaccacccctccctccaagacgtccaccgtcgcggggcacgacgccgcccgtcgggctcgccttggtcaaacggtactacttcgcgttgaatcgaacgtcgaggcggtcgttggaacg

SEQ ID NO: 378361 - DNA, 884 bp, Homo sapiens
  misc_feature: GZ8MTXP01AIUSI.38.26.C04.1.454.CMB.2.raw
  modified_base (289)..(289): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgcctcctcccgattctttggaccaaaaccacactacgcaacacaacgttccaggacagactcaccgattacccgcggacgaactccacgagcacagtctacagtgganatgagtagcctagagtatctcggacgaccgacggtccgtgttactttcgtggtggacgggaaggacggggtacggggggaccgtagggggtcgttacgggggttagggtttaaaccggtttgggttacggttacgtttttggaaattacgggttccgggtacggggggtaacccgaaagggggtacctaaacggtttccggggtaccttaccccgggtccttccccgttaccgaccggtaccccgttaaccccgaaacccgggtaaacccggggtccccctaacccggtttccccgggttcccccgtttccccccgtccgggttaaccccctaaccccccgttccccggtaaccccgaaaccgggtaccgtaacccccggtaccccggttccgggcccggggggtaacccaaacccgggtccgggccccgggggtcccccgttcgggggaacccgttccggggtaccccgtttacgggggtaacccgaaaccgggttacccggttaacccttttcccggaaccgtttcgggaacccgttcgggtaaccccgttgggggacccgggttccggggtccggttaaccggggaacccgg

SEQ ID NO: 378362 - DNA, 662 bp, Homo sapiens
  misc_feature: GZ8MTXP01B4N70.38.26.C04.1.454.CMB.2.raw
  modified_base (139)..(139): a, c, t, g, unknown or other
  modified_base (245)..(245): a, c, t, g, unknown or other
  modified_base (500)..(500): a, c, t, g, unknown or other
  modified_base (559)..(559): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctntttgtggtggcagcagctacaggtgtccagtcccaggtgctagttggtgcagtcgtgggctggaggtagaagagcgtggtcctggtgaacgtccctgctagtctgnggagcctacttcagctactatacttcgagtcgtggtcgacgtacgaccggccccgtaggaacgtaaggtcgttaggaggtggaggtcgggaggtcctacccgtccgtagttcgttacgaacaaaccgactaccctacgacactaacgtacgtaaccgaacgtcgaacgtactaccgaacgtaccgttaccccgggacgggtaaaccaacgtacccaacggacgactaaccgtacggtacctaacgtagtaggganacgtgagttacgcgtagtacgtactacgacgacgcgtacgtcgttgttacgttcgtagnggaacggtagggacggggcgggttacggacgggttcgttacgggttcggttaacgggttggttcgttaagtttacgaagttcggtaacgggttcgggtaacgg

SEQ ID NO: 378363 - DNA, 771 bp, Homo sapiens
  misc_feature: GZ8MTXP01AN1FR.38.26.C04.1.454.CMB.2.raw
tcagtcgatcacgtcacgaccggtgctcgatttagtctagcgactttgggtttggggatcacataacaaccacattccctcctctaaagaagccccctgggagcacagctcatcaccatggactggacctggaggttcctctttgtggtggcagcagctacaggtgtccagtcccaggtgctagttggtgcagtcgtgggctggaggtgaagagccgtgggtcctggtgaacggtcccctgcaaggtcttcgtggacgctaccttcacgtccaaccttattactttcgagtcgtgggtcgaccgtaccgacggtcccccgtaggaaccgtaagggtccttaggaggtgggagtacgggggacggtactcccgtccgtattcgttacggacaaacccgactaacccctaccgacaacctaaccgtaacgttaacccaacgggaaccacggtaaccctaccaaccggtacgttaacccggacgaaaccgaaactcccgaacggactacgaaccgtagtacctaacgagtacgggaagtagtacggtaagtacggtcctagggtaacgtaccgtacgtacggaaacccgtaccggtaccggttaccgtttggttaacttttccggtaggttcgggaacggtaaccggggttagggggtaccgggggaccccggtaaagggggttccggttacgggggttacggggtttaaaccgggttgggttacgtttcggttttaaggcgtttaccgggtaacgggttaacgggggtaaccg

SEQ ID NO: 378364 - DNA, 681 bp, Homo sapiens
  misc_feature: GZ8MTXP01CB5O1.38.26.C04.1.454.CMB.2.raw
  modified_base (656)..(656): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggagttcctctttgtggtggcagcagctacaggtgtccagtcccaggtgcagttggtgcagtcgtgggctggaggtagaagagccgtgggtcctggtgacggtcccctgcaagtcttcgtgggacgcctaccttcgacgctacttattacttcagtcgtgggtcgacgacgcgccccgtaggacgtaagggcttaggacggtaggagtacgggggtaggtaccttcccgtccgtacgttccgttacggaaccaaaccgtaccgaccctaccgactaacgaacgtaccgtaaccgaagtaacagtaacctacgacgtaacgtaccgacggaacgactaccgacgacgaccaacgtagtacctaacgtagtacgggtaagtagtaacggtgtacgtaccgtaggaacgtacgttacgacgacgaccgtacgtacgttacgttacgttcgtagtcgggaagagggcggggtacggggaccggtaggggtcgttacggggttacggttacgggttggttcgtaagttttaggngttacgtcgggttaacggtaacggg

SEQ ID NO: 378365 - DNA, 792 bp, Homo sapiens
  misc_feature: GZ8MTXP01ETS6S.38.26.C04.1.454.CMB.2.raw
  modified_base (764)..(764): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagccgtgggtcctcggtgaacggtccctgcaaggcttcgtggagcaccttcagcacctatactttcagcgtgggtgcgacacggccccgtggacgaagggcttaggaggtcgggagtagggggaggggtactaccccgttcccggaacttccggttttacgggacctaaaaccccgaccgtaaccccttaaccggtaccaaccgtaaccgtaaaccggtttaaccccgaagggaacccgacgggtaaacccttaacccgaaaccggtaaaccgtttaaccccggggaccggggtaaacccgaaacgttaccccgaacggaaccgaaccgaaccagttaacccgtaacctaacgtagggaacgattagggaacgtttaacgccgtaaggtaacggtactaccgttaggaacccgtaacggtaccgggtacccgtttagttacgttttacccgtaggttcggaaccgggtagggacggggtaacggggggttcccgggaaagggggtccgttaccggggttgggtttaaacccggggttggtacgttcgttttacggngttagttccgggttggggtaaacccggg

SEQ ID NO: 378366 - DNA, 752 bp, Homo sapiens
  misc_feature: GZ8MTXP01DPYZ8.38.26.C04.1.454.CMB.2.raw
  modified_base (284)..(284): a, c, t, g, unknown or other
  modified_base (346)..(346): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgcctcctcccgtattccgtttggaccaaacccacactacgcacacaagttccaggacagactcacgattaccgcgacgaatccagagcacagtctacatgganatgagtagcctagagtatctagaaccgacgacggccgttagtattttcgtggtgcggaaggngggacgggggcctagggggtcgttaccggggttaggttaaaccggtttaggggtcgtttacgtttttgaaacgttacgttcggttacgggggaaccctaaagggggacctaaacggttcgggtaaccctacccggttcccttacccgttaccgtacggcccttacccgaaacccggtaaaccggggtcccctacggttccccggttcccgtttaccccccgtcggacccctaacccccgttcccttaacccgaaacggtccgacccgtaccgttccgtcgggggaccaaccggtcggcccgggtcccgtcggggtcctcggtaccgttcgggtaaccgttaaacggtaccttaccgttacccgagttacgtaacgtcgaacgtacgcgggccgggcgttggaaccg

SEQ ID NO: 378367 - DNA, 718 bp, Homo sapiens
  misc_feature: GZ8MTXP01AF3P1.38.26.C04.1.454.CMB.2.raw
  modified_base (349)..(349): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagaagccgtgggtcctcggtgaacggtcccctgcgaaggtcttcgtggaggctaccttcagctactatactttcagtcgtgggtgcgtacgacggcccctaggacgaaagggctttggaggttgggagtgggggaacgggtntaccccgttcccgtatttccgtttagggaccaaaacccgacaaccctaccggacaactaacaacgttaacccgaaggaacacgacctacaaccgtaacttacccggacgggaaccgaaactacccgaacggacggaccaacgacgttactaaccgagagtagattggagtacgtaccgtagagtacgtcgtacggaacgacgaccggtaccggttgttacttcggtcggcggcggaaggggttacgggacgggggaccggtaacgggggtcggttaccgggggttagggttaaccggggtttaagggttcggttttaaccggtttaggtaaccgtttaggttaaccgggttaacgggggtaaacccggg

SEQ ID NO: 378368 - DNA, 752 bp, Homo sapiens
  misc_feature: GZ8MTXP01D3AYY.38.26.C04.1.454.CMB.2.raw
  modified_base (248)..(248): a, c, t, g, unknown or other
  modified_base (258)..(258): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctggtgaacggtccctgcaggcttcgnggagcacctngcactatacttcagtcgtgggtgacgtaccgacggcccccgtagggtacccgaaagggtcttaggaggtgggtaaggtgggggtaagggtaccttccccgttaccggtaacgtttccgtttacggaaccaaaacccgacctaacccgtaacccgactaaccaaccgtaaaccgttaacccgaaggtaaccgacgtaaaccctacccgaaaccggtaccgttaaccccgggacgggaaaccgtaacctaccgaacggacggtaccaacgtaacgtaccgtaaccgtaaggtaggaacgaaacgttaggaaacgttacgacccgggttaaggagtaacgttacccggtaagaaaccggtaccgtaacgggtacccgtttagtttacgttaccgtgggttacggaacggaaggttacgggggacggggcgtacgggggtcttacggggttggttacggttaaggtcttaagttgaagttcgtaacggcgggtaaacg

SEQ ID NO: 378369 - DNA, 684 bp, Homo sapiens
  misc_feature: GZ8MTXP01B8610.38.26.C04.1.454.CMB.2.raw
  modified_base (238)..(238): a, c, t, g, unknown or other
  modified_base (250)..(250): a, c, t, g, unknown or other
  modified_base (660)..(660): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgctagttggtgcagtcgtggggctgaggtagaagagccgtggtccctggtgaacggtcccngacgagtcttgnggacgcctaccttacaactacctattacttcagcgtggtcgacgacgccggcccgtaggacgaaggtacgttggaggtaggaggtaggggacggtacgtccccgtaccgtacgttcgttacggaaccaaaccacctaacgtacccgaccaacaacgtaacgttaccgaaacgggaaccaacgactaccgtaaccgtaaccgttaaccccggacggtaaccgaaaccgtacccgaacgacgaccgtaacgacgttactaacgtacgtaggagtagtacgaacgtagtaccgtaggggtaacgtacgttacgaaccgaccggtaccgacgggtccgtttgtacctttgtggcgcggaagggagggacggggtcggttgggacgttggttaggttcggttgtgttcgttaagngtaggcggtaacggaacgtaacgg

SEQ ID NO: 378370 - DNA, 672 bp, Homo sapiens
  misc_feature: GZ8MTXP01AKQRU.38.26.C04.1.454.CMB.2.raw
  modified_base (497)..(497): a, c, t, g, unknown or other
  modified_base (514)..(514): a, c, t, g, unknown or other
  modified_base (581)..(581): a, c, t, g, unknown or other
  modified_base (638)..(638): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggagttcctctttgtggtggcagcagctacaggtgtccagtcccaggtgcaggttggtgcagtcgtggggctggaggtgaagagccgtgggtcctcggtgaacggtcccctgctaaggtcttcgtgggacggctacccttcacgacctacttagttacctttgacgcgtgggtcgcgaccgacggccccgtggaacgagggtcgttaggaggtgggtaggtagggggacggtactcccgttcccggtagttcgtttacggaccgaaaccacctacccgtaccggactaacgaccgtaacggttaacccacgggaacacgacctacgaacgtacgttacccggcgggaaccgactaccgacgacacgacngtacacgagtcggagtnagacgtagcgtaggatcgacgtcgacgaccgtacggttccgtcgttagttcgaggtgaacggacggnggggaccggggttcgaggggtccggttggggttagggttaacggtttgggttcgttntttaggggtacttgggtccggttgggtaaccggg

SEQ ID NO: 378371 - DNA, 778 bp, Homo sapiens
  misc_feature: GZ8MTXP01BNEAC.38.26.C04.1.454.CMB.2.raw
  modified_base (249)..(249): a, c, t, g, unknown or other
  modified_base (261)..(261): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagccgtgggtcctcggtagaacggtcccctgcaggtcttgnggacgcaccttnacgccactattacttcgagtcgtggtcgacgacgccggcccctaggacgagggtcttggaggtgggagtgggggacgggtactccccggttccgtagttccggttacggaaccaaacccgtaccgtaaacccctaccggaacctaacgaaaccgttaaccggttaaccccaaagggtaaccaacggtaacccgttaaccgaacccgggttaaccgttaacccgggacccggggtaaactaaacccgttaccccggaaaccggaacggaaccctaacgtaacgttacccgaacttaagggtaggaaacgtaacgtaggtaacggtaaccgcggtaaggaacgtaacccgtggtaaccgaaaccggacccgttaaccgggtaccgtttaagttttaccgtttaggtccggaagggaaccggtaggggttaaacccggggcgggggttacgtaccggggttagttaccgggttggttacggttaagtcgttaagttgacttacgggtgaaccgggtaacg

SEQ ID NO: 378372 - DNA, 784 bp, Homo sapiens
  misc_feature: GZ8MTXP01CE7V7.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcaggtcgtggggctggaggtgaagagcgtggtcctggtgaacgtccctgcagtcttgtggagctaccttcagacctactactacttcagcgtgggtcgcgacgaccggccccgtggaaccgaagggtcgttaggaggtcggggtaaggtagggggacgggtaccttcccccgttacccggtacgtttccgtttacgggaaacccctaaaacctaacccgtaaacccccgtacccggaccaaccaaaccgtaaaccggttaacccgaacggaacaaccggtaacctaccgaacgtaaccttacccggacgaacgaaaccgtaacgtacccgaacggaacaccgaacgtacgtacctaaacgtaggtacggaagaagtaggtaacgtacggtccggttaaggaacgtacgtaccgtacggaaccggtaccgtaccggggttccgttagtttacgttcggtcggtaacgggaccgggttaggggacggggttcgggggaccggtacggggttccgggtttacggggttacggggttaaccgggtttagggttcggtttcggtttaacggttacggtttaacggttcggggtaaccggggg

SEQ ID NO: 378373 - DNA, 722 bp, Homo sapiens
  misc_feature: GZ8MTXP01EBBX4.38.26.C04.1.454.CMB.2.raw
  modified_base (247)..(247): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggacaaaccacactacgcacacaagttccaggacagactcacgataccgngacaatccagagcacagtctaacagtagagatgagtagcctgagatctagaaccggacgaccggtccgttgtaatttcgtggtgacggaaggagggacggggggcgacgggggtcttacggggttaggttaaacggtttaggggtgtacttttagaaagttacgtcgggtagggggaccgtaaaagggaacgtaaagttccgggtaccgtaacccgttccttcccgtacctaacggtcccttaaccccgaaaccgtaaaccgggtccctaaccgtccggttcccttacccccgtcggaccctacccctaccctaccgaaacgacgacccgtaccgtcggtccgggggccgtaaacgccggtcccgggcccgtcggggcccttcggcgttacggtcaaacgggtacctaaccgtttaccgacggttacggaactaccggtaacgtcgggacggttccggggtcgttcgggaaccgg

SEQ ID NO: 378374 - DNA, 625 bp, Homo sapiens
  misc_feature: GZ8MTXP01CCUU0.38.26.C04.1.454.CMB.2.raw
  modified_base (251)..(251): a, c, t, g, unknown or other
  modified_base (541)..(541): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctcggtgaacggtcccctgcaaggcttcgnggagctaccttcagcactatactttcagtcgtggtcgcgacgacggccccctaggacgaagggtcttaggaggtggagtgggggacggtacgtcccgtacccgtagttcgtttacggacctaaaccacaccctacgacacgaactacgtaccaaggaacacgactacgacgacgttacccgacggaacgactaccgacgacgacactacgtactacgagtggagtagtacgagtacgtccggtagagtactcgtacgaacgaccgacggtccgttgttacttcgcgtcgnggaggacggggcggggcggaggggtcgttacggggttggttaacggttgggtgtcgtttcgagttacgtcggttcgggtaacgg

SEQ ID NO: 378375 - DNA, 664 bp, Homo sapiens
  misc_feature: GZ8MTXP01AL9YD.38.26.C04.1.454.CMB.2.raw
  modified_base (552)..(552): a, c, t, g, unknown or other
  modified_base (571)..(571): a, c, t, g, unknown or other
  modified_base (633)..(633): a, c, t, g, unknown or other
  modified_base (643)..(643): a, c, t, g, unknown or other
  modified_base (654)..(654): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcaggtcgtggggctggaggtgaagagccgtgggtcctacggtgaacggtcccctgacgagcttcgtggagctaccttcagcacctatacttcagtctggtgacgcacggcccctggacaagggtcttggacgtggagtaggggacgggtatcccgtccgtattcgtttacggaccaaaccgacaacccgttaccggacacgaaaccgtaacgtttacccgaaggaaccgagacccgtacgaaccgtaacttaaccccgggacgggaaaccgtaacgtacccaacgggaacgaccgtaaccgtaacggtactacctaggtaggagtacgagtaccgtagaccgtgaagtacttcgacgacgaccgnggccgttagtacgtttcgnggcgaacggagacgggtcggggccgaaggggtcccgttagggttacggtttaaggttcggtnttccggtttnagttagttcgnggtaaccggg

SEQ ID NO: 378376 - DNA, 706 bp, Homo sapiens
  misc_feature: GZ8MTXP01DW5B8.38.26.C04.1.454.CMB.2.raw
  modified_base (562)..(562): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgctagttggtgcagtcgtggggctggaggtagaagacgcgtgggtcctggtgacgtccctgcagtctcgtggacgcctacctcagcctacttatactttcagtcgtggtcgcgacgaccggccccgtaggacgtaagggtcttaggaggtggtaggtgggggacggtcctccccgtaccgtagttcgttacggaaccaaaccgactacccgtaccgactaaccactaacggtccaaggaacacgacctacacgtacgtaccggacgtaacaacgtcaacgtacgacaactaggttaccaagtagtacggagtagtaggtaacgtacggcgtaaggactacgtcgtaacggaaccgacggtcggttaccgttagttacgtttacgnggtggaacgggacgggagggggaccgggggttaccggtaacgggggttcccgggttaggggtttaccggggttaaacggttggggttccgttttaacggtttaggacggtttacgggttccgggggttaacgggtaaaccgggg

SEQ ID NO: 378377 - DNA, 776 bp, Homo sapiens
  misc_feature: GZ8MTXP01DM34V.38.26.C04.1.454.CMB.2.raw
  modified_base (246)..(246): a, c, t, g, unknown or other
  modified_base (257)..(257): a, c, t, g, unknown or other
  modified_base (296)..(296): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcgtgggtcctggtgaacgtccctgcaggtcttgnggagcaccttnagcactatacttcagtcgtggtgcgtacgacggtccccnggacaagggtctggagtggagtgggaggtctcccgtcgattcgttcggactaaccactacctacgacaactaactacgtaaccaagtaacagactacgaaccgtacgttaacccgggacgaaacaacgtacccgaacgacgacaaccgtacgtaaccgtaagtaacgtagggaaacgtagtaacggtacgtacggtacccggtaaggtaacgtaacgttacggaaccggaacccggtaaccgggtaaccggggttcccggtttaaggttttacgttttaccgggtacgggttccggggtaacggggtaaacggggttaaacggggggcccggggggttaccgggtaaaccggggggttccgggttaaccgggggtttaaacggggtttaacccggggttttaaggggttaccgttttaacggtttttacgggtaacggtttacgggtttccgggggttaacgggggttaaaacccggggg

SEQ ID NO: 378378 - DNA, 658 bp, Homo sapiens
  misc_feature: GZ8MTXP01EG43R.38.26.C04.1.454.CMB.2.raw
  modified_base (205)..(205): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttgcaaaccncactacgcacacaagttccaggacagactcacgattaccgcgacgaactccagagcacagtctacagtggagatgagtagcctgagatcgtagacgacacggtcctagttactttcgtggtgacgaggagggacggggccaggggctcgggtagtaacgttgtgtctttagaattacgtcggtagggaccaaggggactaagtcggtctaccgtctcctcgacgccctaccaccgtaacgggccctacgtccggtccttcccccgagcccctacccctaccggtaccgaagaccgccgtacccgttcggcgggggacctaccgacgggcccggtaccggtcggtccgtccgtccggttacggggtaaccgttaacgggtaccccttaccgtttaccgacgttacggtaaccgcggtaaccgcgggtacggccggggtaacgttcgggaaccgg

SEQ ID NO: 378379 - DNA, 692 bp, Homo sapiens
  misc_feature: GZ8MTXP01BOFRE.38.26.C04.1.454.CMB.2.raw
  modified_base (482)..(482): a, c, t, g, unknown or other
  modified_base (545)..(545): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaaggtgaagagccgtgggtcctcggtgaacggtcccctgcaaggcttcgtggaggctaccttcagcactatacttcagtcgtgggtcgcgacgtacggccccgtaggacgaagggcttggaggtggaggtggggagggtactcccgtaccgtagttcgtttacggaccaaacccgacaaccctaccgacaacaactaacgtacccaaggaacacgactaccacgtaacgttaccgacgaacgtaactccgaacgagcaacgtagtactacagtcggaagtntacgagtacgcggtagaacgtatacgtcgaaccgacgtaccggtccgttagttacgttttcgnggttcggaacgggtagggttacgggggacgggggttaccggtacgggggttcgttaaccgggggttggggtttaaaccgggttggggttacggtttccggttttagggacggtttaacggttccggggttaacgggggtaaacccgg

SEQ ID NO: 378380 - DNA, 665 bp, Homo sapiens
  misc_feature: GZ8MTXP01BB1D0.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtcacatggagatgagtagcctgagatctgacgacgacggccgtgtatttcgtgtgacgaggaggacgggggcaggggtcgtcggtaggttaacggttaggtgtcgttttgaattacgtcgtaggggacccgaaaggggtacaagttcgggtacacccgtcctaccgtacgacgtccctaccctaacccgaaccgggtccctacgtcccgggttcccttacccccgtcggaccctacccctcccgtaccgtaacgacgtaccgaccgtccgtcgggggacctaacgccggaccggtcccgtcgggccgtcggccgttacgggtacaaacgggtaccttaccgttaccgcgttacgaacgttccgaacgttcggacgggttccgggtcgttcgggaaccgg

SEQ ID NO: 378381 - DNA, 708 bp, Homo sapiens
  misc_feature: GZ8MTXP01B0FGY.38.26.C04.1.454.CMB.2.raw
  modified_base (206)..(206): a, c, t, g, unknown or other
  modified_base (231)..(231): a, c, t, g, unknown or other
  modified_base (273)..(273): a, c, t, g, unknown or other
  modified_base (278)..(278): a, c, t, g, unknown or other
  modified_base (292)..(292): a, c, t, g, unknown or other
tcagtcgatcacgtcacgaccggtgctcgatttagtctagcgactttgggtttggggatggttttctcgatggggctgggaggctttgttggagaccttgcacttgtactccttgccattcagccagtcctggtgcaggacggtgaggacgctgaccacacggtacgtgctgttgtactgctcctcccgatctttaaggcaaaccncactacgcacacaagttccaggacngactcacgattaccgcggacgaatccacgagcacagtctacntgganatgagtagcctganagtctgacgacacggtccgtgtactttcgtggtaggccgaaggacgggacggggggtcccgaagggggtcctcggggttagggttaaccggtttaggtgtcgtttttgaaagttacttcgggtaggggacccaaaggggaccaagttcggactaccgtctccgtcacgctaccgacgaacgggccagtccgggtcccttcccccgtcgggtcccctaccccgtttaccctcccgtaaacggtaccgtacccgaacccggtttccggcggggggacctaaacccgttcggtcccgggttccccgcggggtccgtttcggacccgttacgggttaccgaacgggtaccttaacccgttccgttaacggttcgaaccgttccgaacgttcgggcggttcgggccgttcgggtaacccgg

SEQ ID NO: 378382 - DNA, 784 bp, Homo sapiens
  misc_feature: GZ8MTXP01CO485.38.26.C04.1.454.CMB.2.raw
  modified_base (242)..(242): a, c, t, g, unknown or other
  modified_base (629)..(629): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcgagtctggggctgaggtgaagagctgggtctggtgaagtcccctgcagcttcgnggagcacttcagccacctatactttcagcgtgggcgacgacgacggcccccgtaggaaccgaagggtcctttggaggtcggaggtcgggggagggtactcccgtaccccggtaattcgtttacggaacctaaacccgacaaccccgttacggactacgaaccctaaacggttcccgaaagggtaaccaacgtacctaccgtaaccgtacgttaacccgggacggaaacccgtaaactacccggaaccgaaggacctaaaccgtaggttaccctaaacgtaagttaccggggaaagtacgttaaggaacggttaacgacccggttaaggaaagtacctacggtaacgaacccggaacgtacggtacccgtttgtaacttttacccggngttcggaaccgggaaagggttaacggggtaccggggggacgggttacggggtacccgggtttacggggttacgggtttaaacccgggtttgggggttacggttccggtttttaaggtacggttacggtttccggggttaacggggggttaacccg

SEQ ID NO: 378383 - DNA, 679 bp, Homo sapiens
  misc_feature: GZ8MTXP01D44KU.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgccagtcgtggggctggaggtgaagacgccgtgggtcctcggtgaacggtcccctgcaggtcgttgtggacgcaccttcacgcctacttactactttcgagtcgtgggtcgacgtaccgccggtaccccgtaggaccgaaggtccgttggaggtggggagtagggggacggtaacgttccccgttaccggtacgtttccggtttacggaacctaaaccgtaccaacccgttaccgacgaacctaacgaaccgttaacccgaagtaaccgacgtaacctcgaaccgtacgttaaccggcgtaacgaactacgacgacgacacaggtaccagagtaggatagtcggagtacgacgtagtagattacgcgaacgacgccggtacgttcgttagtttcgtcggtgaaccggtggacgggtcgggacggtacgggtcggttaggttgggttaccggttgttcgttaacgtttggagttcgtcgggttcggtaaccggg

SEQ ID NO: 378384 - DNA, 614 bp, Homo sapiens
  misc_feature: GZ8MTXP01BAU82.38.26.C04.1.454.CMB.2.raw
  modified_base (241)..(241): a, c, t, g, unknown or other
  modified_base (247)..(247): a, c, t, g, unknown or other
  modified_base (251)..(251): a, c, t, g, unknown or other
  modified_base (274)..(274): a, c, t, g, unknown or other
  modified_base (305)..(305): a, c, t, g, unknown or other
  modified_base (355)..(355): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcgtggtcctggtgaggtccctgcagcttnggagcncttnagcactatacttcagctgggtcncgacgcggccccgtggacaagggcttacggnggtgggagtcggggaggtactcccgtccgtatcgtttacggactaaaccncacctacgcaacacgaacgtccaaggaacagacctacgaccgtataccggacgtacgactacgacgacgacacagtactacagtaggacgtagtacgaagttacgaccgttaggaacgtactcgtacgaccgtacgtacggtccgttgttactttcgtagtcgcggtacggagggcgggggccgtaggggtacggttcggggttacggtttacgggttaaggtcgttcgtttggtagttcgtaacgggcgggtaacggg

SEQ ID NO: 378385 - DNA, 664 bp, Homo sapiens
  misc_feature: GZ8MTXP01CL2KJ.38.26.C04.1.454.CMB.2.raw
  modified_base (390)..(390): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtctcggtgaaggtccctgcaagtcttgtggagcacttcagcactatacttcagcgtggtgacgacgacggcccgtggacgtaacgggtctaggaggtcggagtcggggaggtactcccgtaccgattcgtttaggacaaaccacaactacgaccactacgtaacgtccaggaaccacnctacgaacgtaactacccggacgaacgaactacccgaacgagaccaagacgttaccaagactaggaagtatgaacgtacgaccgtgaaggtcttaggaccgtaacgaccgtaacgggtccgttagtttacttccgtgggtacggaccggtaagggcggggacgggggacccggtagggggcccgtttagggaacgggttttaaccgggttacggttggttttaaccgtttagcgttaaccggtggttacgggggaacccgttaaagggtaacgg

SEQ ID NO: 378386 - DNA, 525 bp, Homo sapiens
  misc_feature: GZ8MTXP02F7I93.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtattctgtgcgagaggaggggccaggggctcggtggtaacgttaggtgcttttgatatcgtggggccaaagggacaagtggtcaccgtctcctcagcctccaccaaggcccatcgtctcccctggcaccctcctcaagacgcacctctggggcacgagcgcccgtgggctcgcctggtcaaggactactccacgtgaatcgactgagcggctgcg

SEQ ID NO: 378387 - DNA, 554 bp, Homo sapiens
  misc_feature: GZ8MTXP02HC37H.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgatatcgtggggccaaaggggacaagtggtcaccgtctcctcagcctccaccgaacgggccccagtccggtccttccccctcggtccaccccgtcctcccaagacgccacctcgtcgggggcacacgcggcccgtgggctcgcctggtcaaggactacttccacgtgaagtcgactgacgcggctggacg

SEQ ID NO: 378388 - DNA, 531 bp, Homo sapiens
  misc_feature: GZ8MTXP02I178M.38.26.C04.1.454.CMB.2.raw
tcagtcgatcacgtcacgaccggtgctcgatttagtctagcgactttgggtttgggatggttttctcgatgggggctgggaggcgttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgatatcgtggggccaaggggacaatggtcaccgtctcctcagcctccaccaaggcccatcggtctcccctgcaccctcctccaagacgcacctccgtgggggcacgacgcggcccgtgggctcgcctggtcaaggactactccacgtgaatcgactgagcggcgtgcg

SEQ ID NO: 378389 - DNA, 538 bp, Homo sapiens
  misc_feature: GZ8MTXP02F2AQ8.38.26.C04.1.454.CMB.2.raw
tcagtcgatcacgtcacgaccggtgctcgatttagtctagcgactttgggtttgggatggtttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgcttttgattatcgtgggggccaaaggggacaatggtcaccgtctcctcagcctccaccaaggcccatcggtcttccccctggccaccctcctccaagacgaccacctccgtgggggcacgacgcggcccgtgggctcgcctggtcaaggctactcacgtgaatcgactgagcggctggacg

SEQ ID NO: 378390 - DNA, 538 bp, Homo sapiens
  misc_feature: GZ8MTXP02HY4WK.38.26.C04.1.454.CMB.2.raw
tcagtcgatcacgtcacgaccggtgctcgatttagtctagcgactttgggtttgggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgattatcgtggggccaaaggggacaagtggtcaccgtctcctcagcctcaccaagggcccatcggtctcccctgccaccctcctccaacgacgcaccctcgtcgggggcacgagccggcccgtgggctgcctggtcaaggactacttccacgtgaatcgactgagcgggctggcg

SEQ ID NO: 378391 - DNA, 561 bp, Homo sapiens
  misc_feature: GZ8MTXP02HFQNA.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgtcttttgattatcgtgggggccaaggggacaagtggtcaccgtctcctcagcctccaccgacgggcccactcggtccttccccctcggccacccctcctccaacgacgccaccgtcgtcgggggcacgacggccggcccgtcgggctcggccgtggtcaaggcctacttccacgtcgaagtcgactcgagcggtcgcggcg

SEQ ID NO: 378392 - DNA, 526 bp, Homo sapiens
  misc_feature: GZ8MTXP02IWQQ3.38.26.C04.1.454.CMB.2.raw
tcagtcgatcacgtcacgaccggtgctcgatttagtctagcgactttgggtttggggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttagtgcttttgatatcgtggggccaaaggggcaatgggtcaccgtctcctcagcctccaccaggcccatcggtcttcccctgccaccctcctcaagacgcacctctggggcacgacgcggccctgggctgcctggtcaaggactactccacgtgaatcgactgagcggctggcg

SEQ ID NO: 378393 - DNA, 569 bp, Homo sapiens
  misc_feature: GZ8MTXP02I2R1R.38.26.C04.1.454.CMB.2.raw
  modified_base (398)..(398): a, c, t, g, unknown or other
  modified_base (431)..(431): a, c, t, g, unknown or other
tcagtcgatcacgtcacgaccggtgctcgatttagtctagcgactttgggtttggggatggtttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtattctgtgcgagaggaggggccaggggctcggtggtaacgtaggtgtctttgattatcgtggggccaaggggacaagtggtcaccgtcncctcacgcctcaccaggcccatcgtcctccccnggccaccctcctcccaagacgcacctcgtcgggggccacgacgccggcccgtcgggcctcggcctcgggtaccgaaacggtacctaccgttccgaacgttcgaacgtccgaacgtcggacggccggcgtcggaaccgg

SEQ ID NO: 378394 - DNA, 587 bp, Homo sapiens
  misc_feature: GZ8MTXP02HEAX0.38.26.C04.1.454.CMB.2.raw
tcagtcgatcacgtcacgaccggtgctcgatttagtctagcgactttgggtttgggatggtttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacgacggccgtgtattctgtgcgagaggaggggccaggggctcggtggtaacgttaggtgtctttgattatcgtggggaccaagggacaagtggtacaccgtctcctcacgcctccaccgacggcccacgtccggtccttcccccgtcggccacccctcctacccaagacgaccaccctcgtcgggggccacgacggccggcccgtcgggccgtcgccgtggtaccaaacgggaccttaccgttaccgaacgtcgaacgtccggaactcggacggccgggtcgcggaccg

SEQ ID NO: 378395 - DNA, 573 bp, Homo sapiens
  misc_feature: GZ8MTXP02ISA1A.38.26.C04.1.454.CMB.2.raw
  modified_base (340)..(340): a, c, t, g, unknown or other
  modified_base (466)..(466): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtgcgacaggcccctggacaagggcttgagtggatgggaggatcctcccgatcttgcaaacncacctacgcacacaagttccagcagactcacgacttaccgcggacaactccacgagcacagtctacatggagatgagtacgcctaggagatcgacgaacgacgacggtccgttagttacttttcgnggtacggacggaggacggggacgggggaccggacgggggtcgttacggggttacggttaacggttggttcggttcgtttaggacgtttacggtcggtacggggaacg

SEQ ID NO: 378396 - DNA, 519 bp, Homo sapiens
  misc_feature: GZ8MTXP02G5QHD.38.26.C04.1.454.CMB.2.raw
  modified_base (343)..(343): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacagacccctggacaagggcttgagtggatgggaggatcctccgatcttggcaaaccncacctacgcacacaagtccagcagactcacgattaccgcggacgaatccacgagcacagtctacatggagatgagtagcctgagatctgacgacacggccgtgtattctgtgcgagaggacgggggccaggggctcgggtggtaacgttaaggtgtctttgatacgtcgtgggacg

SEQ ID NO: 378397 - DNA, 534 bp, Homo sapiens
  misc_feature: GZ8MTXP02GFLHB.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagagaggggccaggggctcggtggtaacgttaggtgcttttgatatcgtggggccaaaggggacaatggtcaccgtctcctcacgcctccaccaacgggcccatcggtctccccctggccaccctcctccaagagcacctctggggcacacgcggccctgggctcgcctggtcaaggactacgttcacgtgaatcgactgagcggctggacg

SEQ ID NO: 378398 - DNA, 591 bp, Homo sapiens
  misc_feature: GZ8MTXP02HA22N.38.26.C04.1.454.CMB.2.raw
tcagtcgatcacgtcacgaccggtgctcgatttagtctagcgactttgggtttggggatggttttctcgatgggggctgggagggcgtttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgtacgttttgattatcgtggggccaaggggacaagtggtcaccgtctcctcacgcctccaccgaacgggcccatccggtccttccccctggccaccctcctccaagacgccacctcgtcgggggccacgacggccggcccgtgggccttcggcccgtggtaccgaaacgggacctaccgttcccgaaccggttgaacgttccgaccgtggacggccgggccggtacggacg

SEQ ID NO: 378399 - DNA, 581 bp, Homo sapiens
  misc_feature: GZ8MTXP02JT5MT.38.26.C04.1.454.CMB.2.raw
  modified_base (284)..(284): a, c, t, g, unknown or other
  modified_base (428)..(428): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatacttcagctgggtncgacacggcccctggacaagggcttgagtggagtggggagggactccgtcccgattcgtttggaccaaaccacacctacgcacacaagtcccaggacagactcacgataccgcgaacgactccacgagcacagtcacagtgganatgagtagcctggacgatccgtagaaccgacgacgggcccgttggttaactttccgtagtggacggaaggagggacgggggccagggggtcctacggggtagggttaaacggttggtgttcgttttaggaagttagtccggtaggggaacccg

SEQ ID NO: 378400 - DNA, 537 bp, Homo sapiens
  misc_feature: GZ8MTXP02HZHH0.38.26.C04.1.454.CMB.2.raw
tcagtcgatcacgtcacgaccggtgctcgatttagtctagcgactttgggtttgggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagagaggggccaggggctcggtggtaacgttaggtgcttttgattatcgtggggccaaaggggcaagtggtcaccgtctcctcagcctaccaccaaaggccccatcggtccttcccctcggccaccctcctccaagacgcaccctcgtcggggcacgacgcggcctggctcgcctggcaaggcgtactccacgtgaagtcgactgagcggctcgacg

SEQ ID NO: 378401 - DNA, 558 bp, Homo sapiens
  misc_feature: GZ8MTXP02GN70C.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgtgagagaggggccaggggctcggtggtaacgttaggtgcttttgattagtcgtgggggccaaaggggacaagtggtcaccgtctcctcagcctccaccaacgggcccactcggtccttccccctcggccacccctcctcccaacgacgccaccctcgtcgggggcacgacgccggcccgtcgggctcgccgtggtcaaggactacttccacgtgaatcgactcgagcggcgtggacg

SEQ ID NO: 378402 - DNA, 540 bp, Homo sapiens
  misc_feature: GZ8MTXP02HSZVC.38.26.C04.1.454.CMB.2.raw
  modified_base (339)..(339): a, c, t, g, unknown or other
  modified_base (412)..(412): a, c, t, g, unknown or other
  modified_base (454)..(454): a, c, t, g, unknown or other
tcagtcgatcacgtcacgaccggtgctcgatttagtctagcgactttgggtttggggatcacataacaaccacattcctcctctaaagaagccctgggagcacagctcatcaccatggactggacctggaggttcctctttgtggtggcagcagctacaggtgtccagtcccaggtgcagttggtgcagtctggggctgaggtgaagagcctggtcctcggtgaaggtccctgcaaggcttctggaggcaccttcagcacctatactttcagctgggtgcgacaggcccctggacaagggcttgagtggatgggaggatcctccgatcttggcaaaccncacctacgcacacaagttcccaggacagactcaccgataccgcgacgaatccacgagcacagtctacatgganatgagtagcctgagatcgtgacgacacggccgtgtatttcgngtgcgtaggaggacgggggccgagggggcgtacggggttggtaacggttaagggtgtcgttttggagttacgtcgttaggggaccg

SEQ ID NO: 378403 - DNA, 536 bp, Homo sapiens
  misc_feature: GZ8MTXP02GKDSO.38.26.C04.1.454.CMB.2.raw
  modified_base (283)..(283): a, c, t, g, unknown or other
  modified_base (412)..(412): a, c, t, g, unknown or other
  modified_base (426)..(426): a, c, t, g, unknown or other
  modified_base (430)..(430): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtactcggtgaaggtcccctgcaaggcttctggaggcaccttcagcacctatactttcagctgggtncgacaggcccctggacaaggcttgagtggatgggaggatccgtcccgattcttggacaaaccacacctacgcacacaagtccagcagactcacgataccgcgacgaatccagagcacagtctacatganatgagtagctgagntcgngacgacacggtcgtgtattcgtagtgcgaggaggacgggggcgaggggtcgtacgggtaggttaacggttaaggtcgtacgtttaggattagtcggtagggaaccg

SEQ ID NO: 378404 - DNA, 521 bp, Homo sapiens
  misc_feature: GZ8MTXP02GGJ04.38.26.C04.1.454.CMB.2.raw
  modified_base (454)..(454): a, c, t, g, unknown or other
tcagtcgatcacgtcacgaccggtgctcgatttagtctagcgactttgggtttgggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttggtgcttttgatatcgtggggccaaggggacaatgggtcaccgtctcctcagcctcaccaggcccatcgtctcccctgcaccctcctccaagagcacctcnggggcacagcggcctgggctgcctggtcaaggactacttccacgtgaatcgactgagcgggctggcg

SEQ ID NO: 378405 - DNA, 541 bp, Homo sapiens
  misc_feature: GZ8MTXP02HZNTA.38.26.C04.1.454.CMB.2.raw
  modified_base (440)..(440): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgattatcgtggggccaaggggacaagtggtcaccgtctcctcacgcctccaccaagggcccatcggtccttccccnggccaccctcctccaagacgcacctcgtggggcacgacgccggcctgggctcgcctggtcaaaggctactccacgtgaacgtcgactgacgcggctggacg

SEQ ID NO: 378406 - DNA, 527 bp, Homo sapiens
  misc_feature: GZ8MTXP02JRBY1.38.26.C04.1.454.CMB.2.raw
  modified_base (346)..(346): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatcctcccgatctttggcaaaccncacctacgcacacaagttccaggcagactcacgataccgcgacgaatccacgagcacagctacatggagatgagtagcctgagatctagacgacacggccgtgtatttcgtgtcgcgagaggacgggggccaggtcgacgtcgggtaggtaacgttggtgtctttggatagtcgtacgggg

SEQ ID NO: 378407 - DNA, 613 bp, Homo sapiens
  misc_feature: GZ8MTXP02JNWHM.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtcggtaacgttaggtgcttttgatatcgtggggcaaagggacaagtggtcaccgtctcctcacgcctccaccgaacgggccccacgtccgggtccttcccccgtcggcccacccctcctacccaacgacgccacccgtccgtcgggggccaccgacgccggcccgtcggggcctcggcccgtcgggtccgaaacgggaccttaaccgttcccgaacggttcgaacgttccggaaccgttgggaacggccgggggcgttcgggaaccgg

SEQ ID NO: 378408 - DNA, 548 bp, Homo sapiens
  misc_feature: GZ8MTXP02IHVC8.38.26.C04.1.454.CMB.2.raw
  modified_base (278)..(278): a, c, t, g, unknown or other
tcagtcgatcacgtcacgaccggtgctcgatttagtctagcgactttgggtttggggatggttttctcgatgggggctgggagggctttgttggagaccttgtacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacacggccgtgtatttctgtgcgagagaggggccaggggctcggtggtaaccgttaggtgtcttttgatatctgggggccaaggggacaagtggtcacgtctcctcagcctccaccaagggcccatcggtcttccccctggccaccctccctccaacgcgccacctcgtcgggggcacgagccggccctgggctcggcctggtcaacggtacctacttccacgtgatcgactgacgcggctggcacgg

SEQ ID NO: 378409 - DNA, 630 bp, Homo sapiens
  misc_feature: GZ8MTXP02G8I8C.38.26.C04.1.454.CMB.2.raw
  modified_base (285)..(285): a, c, t, g, unknown or other
  modified_base (428)..(428): a, c, t, g, unknown or other
  modified_base (456)..(456): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctcggtgaacggtcccctgcaaggtcttcgtggaggcaccttcagcacctatacttcagctgggtncgacgacggcccctggacgaagggtcttggaggtggagtggggaggtactcccgtccgatcgttggaccaaaccacacctacgctacactacgtccgagacacgactaccgacgtacgtaccgacgtaacgaactccgaacgngacacgtacgtacgtacagtaggagtanaggtaagtcaccgtagtaacgattacgagaaccgacgacgacggtccgttagttactttcgtacggtacggacgggtaggacgggggacgggggcccggtaagggggttcccgtggggttaaccggttaagggttggtcgttacggttttagaaccgttggtcggtaacggggg

SEQ ID NO: 378410 - DNA, 611 bp, Homo sapiens
  misc_feature: GZ8MTXP02HZV8V.38.26.C04.1.454.CMB.2.raw
  modified_base (206)..(206): a, c, t, g, unknown or other
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccncactacgcacacaagttccaggacagactcacgattaccgcggacgaatccacgagcacagtctacatggagatgagtagcctgagatctgacgacacggccgtgtatttcngtgcgagaggaggggccaggggctcggtggtaacgtttaggtgtcgtttttgattagtcgttagggggaccaaagggggactaaagtcgggtacctacccggtcctccgtcaacgccctccgaacccgaacggcccacgtccggtccttcccccgtcggccacccctccctaccaacgacgccaccgtcgcgggggcacgcgccggcccgtcggcctcgccgtcggtaccgaaacggacctaaccgttcccacgttacgaacgtcgtaacgtcggacgccgggcgtcggacgg

SEQ ID NO: 378411 - DNA, 545 bp, Homo sapiens
  misc_feature: GZ8MTXP02IN7WT.38.26.C04.1.454.CMB.2.raw
  modified_base (434)..(434): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcgcgattaccgcggacgaatccacgagcacagtctacatggagatgagtagcctgagatctgacgacacggcctgtatttctgtgcgagagaggggccaggggctcggtggtaacgttaggtgcttttgattatcgtggggccaaaggggcaagtggtcaccgtctctcagcctccaccaaggcccatcgtcttccccngccaccctcctcccaagacgccaccctcgtacgggggccacgacgccggcccgtgggcctcgccgtggtcaaggactacgttccacgtcgaatcgactcgagcggctggcg

SEQ ID NO: 378412 - DNA, 532 bp, Homo sapiens
  misc_feature: GZ8MTXP02ILKGB.38.26.C04.1.454.CMB.2.raw
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggaggatccgtcccgatctttggcaaaccacacctacgcacacaagtccaggacagactcacgattaccgcgacgaatccacgagcacagtctacatggagatgagtagcctgagatcagacgacacggccgtagtattctgtgcgagaggagggggccgaggggcgtcgggtaggtaacgttggtgtacgtttggattagtaccgtggggaaccgg

SEQ ID NO: 378413 - DNA, 563 bp, Homo sapiens
  misc_feature: GZ8MTXP02HCKS0.38.26.C04.1.454.CMB.2.raw
  modified_base (282)..(282): a, c, t, g, unknown or other
  modified_base (350)..(350): a, c, t, g, unknown or other
  modified_base (464)..(464): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtncgacacggcccctggacaaggcttgagtggagtggggaggactcccgtccgatcgtttggccaaaccncaccctacgcacacagtccagcagactcacgatacgcgacgaatccacgagcacagtcacacgtggagagtgagtagcctagagatcgtagacgacacggtcgtagttattcgngtcgacgaggacgggacgggggccgacgggggtcgtacggggtaggttaacggttaaggtcggtcgttttacggagttcgtacggtacggggtaaccgg

SEQ ID NO: 378414 - DNA, 528 bp, Homo sapiens
  misc_feature: GZ8MTXP02GQRSX.38.26.C04.1.454.CMB.2.raw
tcagtcgatcacgtcacgaccggtgctcgatttagtctagcgactttgggtttgggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgatatcgtggggccaaaggggcaatggtcaccgtctcctcagcctcaccaacggcccatcggtccttccccctggccaccctcctccaacgagcacctcgtggggcacagcgcctgggctgcctggtcaaggactactccacgtgaatcgactgagcggctggacg

SEQ ID NO: 378415 - DNA, 610 bp, Homo sapiens
  misc_feature: GZ8MTXP02IYQU7.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggaggggccaggggctcggtggtaacgttaggtgtcttttgattagtcgtggggaccaagggacaagtggtacacgtctcctcacgcctaccaccgaacggcccagtccggtccttcccccgtggaccctacccctccttacccaacgacgccacccgtcgtcggggaccaccgacgcccggcccgtcggggcctcgccgtcggtaccgaaacggtaccgttaccgttacccgaacgtacgaacgttccggacgtacggaacggccggggtacgtcggaaccgg

SEQ ID NO: 378416 - DNA, 537 bp, Homo sapiens
  misc_feature: GZ8MTXP02HDW96.38.26.C04.1.454.CMB.2.raw
  modified_base (318)..(318): a, c, t, g, unknown or other
  modified_base (471)..(471): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggagggggccaggggctcggtcggtaacgttaggtgcttttgatatcgtggggccaagggacaatggcaccgtctctcagcctcaccgaggcccatccggtctccccctggccacccgtcctcaaagcgcacctcgtggggcacngccggccctgggcctgccgtggtcaaggactacgttccacgtgaagtcgactgagcggctcggacg

SEQ ID NO: 378417 - DNA, 601 bp, Homo sapiens
  misc_feature: GZ8MTXP02HYNMQ.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgatatcgtggggaccaaaggggacaaatggtcaccgtctcctcacgccctccaccaagggcccatccggtccttccccctggccacccctcctaccaagacgccacctcgtcgggggccacgacggtccggccccgtggggccttcggacccgtgggtaccaaacgggtaccttaaccgttcccgaacggttcgaacgttccgaaccgttggaacggccggggcgtcgggaaccgg

SEQ ID NO: 378418 - DNA, 531 bp, Homo sapiens
  misc_feature: GZ8MTXP02JC3T9.38.26.C04.1.454.CMB.2.raw
  modified_base (345)..(345): a, c, t, g, unknown or other
  modified_base (417)..(417): a, c, t, g, unknown or other
  modified_base (453)..(453): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggaggatcctcccgatctttggcaaaccncacctacgcacacaagttcccaggcagactcacgattaccgcgacgaatccacgagcacagtctacatgganatgagtagcctgagatctagacgacacggccgtgtntttacgtgtgcgagaggagggggccaggggctcgggtgtaacggttaaggtgtacgttttgatagtcgtggggaaccg

SEQ ID NO: 378419 - DNA, 579 bp, Homo sapiens
  misc_feature: GZ8MTXP02GAQ3P.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgaggaggagggggccaggggctcggtggtaacgttaggtgtcttttgattatcgtgggggaccaaaggggacaagtggtcaccgtctcctcacgcctccaccgaacggcccacgtccggtccttcccccgtcggccacccctcctccaacgacgccaccgtcgtcgggggcacgacgccggcccgtcgggctcgccgtcggtacgaacggtactaccgttccacgtcgaagtcgacgtcggacggcgggcgtcggacg

SEQ ID NO: 378420 - DNA, 614 bp, Homo sapiens
  misc_feature: GZ8MTXP02HNU93.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatcttttggcaaaccacactacgcacacaagttccaggacagactcacgattaccgcggacgaatccacgagcacagtctacatggagatgagtagcctgagatctgacgacacggcctgtatttctgtgcgagaggaggggccaggggctcgggtggtaacgttaggtgtcttttgatagtcgtggggaccaaaggggacaagtcggtctacccgtctcctcacgccctaccaccgaacgggcccacgtccggtcccttcccccgtcggccctacccctcctacccgaaacgtacgacctacccgtcgtcgggggacacgacgcccggcccgtcgggcctcgccgttcggtacaaacgggaccttaccgtacccgtacgtacgtaacgtccgaacgtcggacggccgggtcgtacggaccgg

SEQ ID NO: 378421 - DNA, 581 bp, Homo sapiens
  misc_feature: GZ8MTXP02J1IHG.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgtcttttgattatcgtggggccaaggggcaatggtcaccgtctcctcacgcctccaccacgggcccactcggtccttccccctcggccacccctccctccaacgacgccaccctcgtcgggggccacgacgccggccccgtcggggcctcggccgtcggtccgaaacgggacctaaccgttcccgaacgttcgaagtcgaccgtggacggcgggcgtggaccg

SEQ ID NO: 378422 - DNA, 612 bp, Homo sapiens
  misc_feature: GZ8MTXP02IT6ZA.38.26.C04.1.454.CMB.2.raw
tcagtcgatcacgtcacgaccggtgctcgatttagtctagcgactttgggtttggggatggttttctcgatggggactgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccgaggggcgtcgggtaggtaacgttaggtgtctttttgattatcggtggggacaaaggggacaagtcggtacaccgtctcctcacgccctacccgaccgaacgggcccacgtccggtcccttccccgtcggccctacccctccctaccgaacgacgccaccgtcggtcgggggaccacgcggccggcccgtcgggccgtcggccgtcggtaccgaaacggtaccttaaccgttccgtaacgttcgaacgtacgacgtcggacggcgggcgtcggacgg

SEQ ID NO: 378423 - DNA, 538 bp, Homo sapiens
  misc_feature: GZ8MTXP02H4X61.38.26.C04.1.454.CMB.2.raw
  modified_base (460)..(460): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggcaccttcagcacctatactttcagctggtgcgacaggcccctggaccaagggcttgagtggatgggaggatcctccgatctttggcaaaccacactacgccacacagtccaggacagctcacgattaccgcggacgaatcccacgagcacagtctacatggagatgagtagcctagacgatctgacgacgacggccgtgtattcgtgtgcgngaaagcgggggacgacggggcgtcggtcggtaacgttaggtgtcgttttggattacgtcgtcggggtaccgaaggacg

SEQ ID NO: 378424 - DNA, 559 bp, Homo sapiens
  misc_feature: GZ8MTXP02GJFUR.38.26.C04.1.454.CMB.2.raw
  modified_base (406)..(406): a, c, t, g, unknown or other
  modified_base (412)..(412): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctggtcctcggtgaaggtccctgcaaggcttctggaggcaccttcagcacctatactttcagctgggtgcgacaggcccctggacaaggcttgagtggatgggaggatccgtcccgatcgtttggacaaaccacaccctacgcacacaacgtccaggcagactcacgataccgcgacatccacgagcacagtcacntagganatgagtagctgagatcgtagacgacgacgggccgtagtatttcgtgttgcgtaggagggacgggggaccgagggggtccgtacggggtgggttaaacggttaagggtcgtacggttttagaacgttacgtcggtacggggtaaccgg

SEQ ID NO: 378425 - DNA, 578 bp, Homo sapiens
  misc_feature: GZ8MTXP02JMSSY.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgatatcgtggggccaagggacaagtggtcacgtctcctcagcctccaccgaacgggcccagtccggtccttcccccgtcggccacccctcctaccaacgacgccaccctcgtcgggggacaccgacggccggcccgtgggcctcggccgtgggtccgaaacgggacctaccgttccgaacgtcgaacgttcgactcggaggccggcgtcggacg

SEQ ID NO: 378426 - DNA, 544 bp, Homo sapiens
  misc_feature: GZ8MTXP02JYVKP.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacaggcccctggacagggcttgagtggatgggaggatcctccgatctttggcaaaccacacctacgcacacaagttccaggcagactcacgataccgcgacgaatcccagacgcacagtctacatggagatgagtagcctagagatcgtagacgacgacgggccgtgtactttcgtggtgacggaggaggacgggggccgaggggcgtcgggtaggtaaacggttggtacgtcgtttggagttacgtcggtggggaaccg

SEQ ID NO: 378427 - DNA, 562 bp, Homo sapiens
  misc_feature: GZ8MTXP02GYW93.38.26.C04.1.454.CMB.2.raw
tcagtcgatcacgtcacgaccggtgctcgatttagtctagcgactttgggtttggggatggttttatcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcggacgaatccacgagcacagtctacatggagatgagtagcctgagatctgacgacacggccgtgtattctgtgcgagaggaggggccaggggctcgggtggtaacgttaggtgtcttttgattagtcgtgggggccaaaggggacaagtggtcaccgtctcctcacgcctccaaccgaacggcccactccggtccttcccccgtcggcccaccctcctaccaagacgccacctccgtggggacacgacgccggcccgtgggctcgcctggtacaaggactacgtccgacgtgaacgtcgactgagcggctcggacg

SEQ ID NO: 378428 - DNA, 548 bp, Homo sapiens
  misc_feature: GZ8MTXP02G473B.38.26.C04.1.454.CMB.2.raw
  modified_base (431)..(431): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagtctgggtgcgacaggcccctggacaagggcttgagtggatgggaggatccctcccgattcgtttggaccaaaccacacctacgcacacagttcccaggacagactcaacgacttaccggcgacgaaactccacgacgcacagtactacatagganatgagtagcctagagatcgtagaccgacgacggcgtggtattcgtgtgcgaggaggacggggccgacggggcgtcggtaggttaacggtggtgtcgtttgatagtcgcggggtaacg

SEQ ID NO: 378429 - DNA, 550 bp, Homo sapiens
  misc_feature: GZ8MTXP02GKUZH.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggaggggccaggggctcggtggtaacgttaggtgtcttttgattagtcgtggggccaaagggacaatggtcaccgtctcctcagcctccaccgaagggcccatcggtccttccccctggccaccctcctccaagcgccacctcgtgggggcacgacgccggccgtgggctcgccgtggtccaaacggctactccacgtcgaagtcgactgacggcggcgcggcg

SEQ ID NO: 378430 - DNA, 559 bp, Homo sapiens
  misc_feature: GZ8MTXP02H0JJK.38.26.C04.1.454.CMB.2.raw
  modified_base (279)..(279): a, c, t, g, unknown or other
  modified_base (352)..(352): a, c, t, g, unknown or other
  modified_base (391)..(391): a, c, t, g, unknown or other
  modified_base (417)..(417): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctggtcctggtgaaggtccctgcaaggcttctggaggcacttcagcacctatactttcagctgggtncgacacggcccctggacaaggcttggagtggagtggggagggactcccgtcccgattcgtttggaccaaaccncacctacgcacacaagtccaggcagactcacgataccgngacatccacgagcacagtcacatganatgagtagcctagacgatcgtagacgacacggtccgtagttactttcgtgtcgacgaggagggacgggggccgaagggggtccgtcggggttaggtaacggttaaggtcgtacgtttttgagttagttcggtacggggaccg

SEQ ID NO: 378431 - DNA, 522 bp, Homo sapiens
  misc_feature: GZ8MTXP02GU06T.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatcctccgatctttggcaaaccacacctacgcacacaagttccaggcagactcacgataccgcggacgaaatccacgagcacagtctacatggagatgagtagcctgagatctgacgacacggccgtgtatttctgtgcgagagaggggccagggggctcggtggtaacgttggtgcgttttgatagtcgtggggtaccg

SEQ ID NO: 378432 - DNA, 585 bp, Homo sapiens
  misc_feature: GZ8MTXP02GHNAG.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgtcttttgattatcgtggggccaaaggggacaagtggtcaccgtcgtcctcacgcctccaccgaacgggcccatccggtccttcccctcggccaccctcctccaagacgccacctcgtcggggcacgacgccggcccgtgggcctcggcccgtggtaccgaaacgggacctaccgttcccgacggttcgaacgttccgacgtcggacggccgggcgtcgggaccgg

SEQ ID NO: 378433 - DNA, 537 bp, Homo sapiens
  misc_feature: GZ8MTXP02JWF6Y.38.26.C04.1.454.CMB.2.raw
  modified_base (454)..(454): a, c, t, g, unknown or other
  modified_base (471)..(471): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggaacgttaggtgctttttgatatctgggggccaaggggacaagtgggtcaccgtctcctcacgcctccaccacgggcccatcggtcttcccctggcaccctcctccanacgcacctctgggggcncgacgcggccctgggctcgcctggtcaaggactactccacgtcgaatcgactcgagcggctggacg

SEQ ID NO: 378434 - DNA, 587 bp, Homo sapiens
  misc_feature: GZ8MTXP02GGPQF.38.26.C04.1.454.CMB.2.raw
  modified_base (428)..(428): a, c, t, g, unknown or other
  modified_base (445)..(445): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttctggaggcaccttcagcactatacttcagctgggtgcgacacggcccctggacaagggcttgagtggagtggggaggactcccgtccgattcgttggacaaaccacacctacgcacacagtcaggcagactcgacgacttaccggcgaacaactccgaacggagacacagtactacagtgganagtgagtacgcctaganatcgtagaccgacgacggtccgttagttactttcgtgtcggacgagggagggacgggggaccgtagggggtccgttacgggggtacggttaaggttaagggtcgttacgttttacggagttacgtcgggtacggggaaccgg

SEQ ID NO: 378435 - DNA, 559 bp, Homo sapiens
  misc_feature: GZ8MTXP02HO2C3.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgtcttttgattatcgtgggggaccaaggggacaaagtggtcacccgtctcctcacgcctccaccacgggcccatcgtcttcccctgccaccctcctaccaagacgccacctcgtcgggggcacgacgccggcccgtgggcctcgcctggtcaaacggtctaccgttccaccgtgaacgtcgacgtgacggcggcgtcggcg

SEQ ID NO: 378436 - DNA, 559 bp, Homo sapiens
  misc_feature: GZ8MTXP02HK46N.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagagaggggccaggggctcggtggtaacgttaggtgcttttgatatcgtggggccaaagggacaagtggcaccgtctcctcagccctccaaccaacgggcccaacgtccggtccttcccccgtcggccacccctccctacccaagacgccaacccgtcgacgggggccacgacgccggcccgtgggctcgcctggtcaaggctacttccacgtgaacgtcgactgagccggctggcg

SEQ ID NO: 378437 - DNA, 583 bp, Homo sapiens
  misc_feature: GZ8MTXP02FX8FA.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaaacgttaggtgtcttttgattagtcgtggggaccaaaggggacaagtggtcaccgtctcctcacgcctcccaccgaacgggcccacgtccggtcccttcccccgtcggccacccctccctacccaagacgccacctccgtcgggggacacgacgccggcccgtgggcctcggcctggtcgaaaggaccgttacctaccgacgtcgaacgtcgactcggaggcgggctcggacg

SEQ ID NO: 378438 - DNA, 574 bp, Homo sapiens
  misc_feature: GZ8MTXP02GSQ66.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtatgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcgggtggtaacgttagggtgtcttttgattgtcgtgggggccaaggggacaagtggtcaccgtctcctcacgcctcccaccacgggcccacgtccggtccttcccccgtcggcccacccctccctaccaacgacgccaccgtcgtcgggggcacgacgccggcccgtcgggctcgccgtcggtacaacggtaccgtaccttccgacgtgactcgactgacggcgggcgtcgg

SEQ ID NO: 378439 - DNA, 568 bp, Homo sapiens
  misc_feature: GZ8MTXP02HRBEN.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcgggtggtaacgttaggtgtcttttgattatcgtggggaccaaggggaccaagtggtcaccgtctcctcacgcctcaccgaacgggcccactcggtccttcccccgtcgccacccctcctccaacgacgccacctcgtcgggggcacgacgccggcccgtgggccgtcgccgtggtcaacggacctaccgttccgacgtgaactcgactcgagtccggcgtcggacg

SEQ ID NO: 378440 - DNA, 530 bp, Homo sapiens
  misc_feature: GZ8MTXP02H7LBL.38.26.C04.1.454.CMB.2.raw
  modified_base (282)..(282): a, c, t, g, unknown or other
  modified_base (345)..(345): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtncgacaggcccctggacaagggcttgagtggatgggaggatccgtcccgatcttggccaaaccncacctacgcacacaagttccaggcagactcacgattaccgcgacaatccacgagcacagtctacatggagatgagtagcctgagatcagacgacacggccgtgtatttctgtgcgagaggagggggccgaggggcgtcgggtaggtaacggttaaggtgtcgttttgatacgtcgtaggggaccg

SEQ ID NO: 378441 - DNA, 537 bp, Homo sapiens
  misc_feature: GZ8MTXP02IIZFA.38.26.C04.1.454.CMB.2.raw
  modified_base (345)..(345): a, c, t, g, unknown or other
  modified_base (399)..(399): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtgcgacaggcccctggacaagggcttgagtggatgggagggatcctcccgatctttggcaaaccncacctacgcacacaagttccaggcagactcacgattacgcggacgaatcacgancacagtctacatggagatgagtagcctgagatactgacgacgacggccgtgtatttctgtgcgagaggacgggggcgacggggcgtacgggtggtaacggttaaggtgtcgttttagagttagtcgtaggggaaccgg

SEQ ID NO: 378442 - DNA, 571 bp, Homo sapiens
  misc_feature: GZ8MTXP02FU6TS.38.26.C04.1.454.CMB.2.raw
  modified_base (369)..(369): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgctgacgaatccacgagcacagtctacatggagatgagtagcctgagatctgacgacacggccgtgtatttctgtgcgagagaggggccaggggctcgggtggtaacgttaggtgcttttgatntcgtgggggccaaggggacaagtggtcaccgtctcctcacgcctccaccacggcccagtcgtctcccccgtgccaccctcctccaagacgccacccgtcgtcgggggcacgacggccggcccgtcgggcctcggcctcgggtaccaacgggtaccttaccgttccacggtcgaactccggactcggacggccgggctacggg

SEQ ID NO: 378443 - DNA, 577 bp, Homo sapiens
  misc_feature: GZ8MTXP02HE1FT.38.26.C04.1.454.CMB.2.raw
  modified_base (318)..(318): a, c, t, g, unknown or other
  modified_base (445)..(445): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagagaggggccaggggctcggtcggtaacgttggtgtcttttgattatcgtggggacaaggggacaagtcggtcaccgtctcctcacgcctccaccgacggcccagtccgtccttcccccgnggcccaccccgtcctaccgaagacgccaccctcgtcggggcacgacgccggcccgtgggcctcgcccgtggtaccgaacggacttaccgttccgacgttcgaacgtcgacgtcggacgtcgggcgtcggacg

SEQ ID NO: 378444 - DNA, 572 bp, Homo sapiens
  misc_feature: GZ8MTXP02GB420.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgcttttgattatcgtggggcaaggggacaagtggtcaccgtctcctcagcctccaccagggcccatccggtccttcccctggccaccctcctccaagacgcacctcgtcgggggcacgacggccggcccgtcgggctcggccgtcgggtccgaaacgggaccttaccgttacccgacgtgaacgttccggacgtcggacgcgggctcgggacg

SEQ ID NO: 378445 - DNA, 539 bp, Homo sapiens
  misc_feature: GZ8MTXP02F3ULU.38.26.C04.1.454.CMB.2.raw
  modified_base (420)..(420): a, c, t, g, unknown or other
  modified_base (462)..(462): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggttaagaagcctgggtcctcggtgaaggtcccctgcaaggcttctggaggcaccttcagcacctatactttcagctgggtgcgacaggccccctggacaagggcttgagtggatgggaggatcctcccgatctttggacaaaccacactaccgcacacaagttccaggacagactcacgattaccgacgacgaatccacgagcaacagtctacatgganatagagtagcctgagatctagacgacgacggccgtgtattcngtgcgagaggaggggcgaggggctcgggtaggtaacggttaggtgtcgttttgactagtcgtagggaccgtaaaggg

SEQ ID NO: 378446 - DNA, 569 bp, Homo sapiens
  misc_feature: GZ8MTXP02ILOHI.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaagggcttctggaggcaccttcagcacctatactttcagctgggtgcgacacggcccctggacaagggcttgagtggagtgggaggactccgtcccgatcgtttggacaaaccacacctacgacacacaagttccagcagactcacgataccgcgacactccacgagacacagtactacataggagatagagtagcctagagatcgtagacgacgacggccgtgttactttcgtgtacgcggaggacgggacgggggccgacgggggtcgtcggggtaggttaacggttaagggtgtacgttttggagttacgtcggttacggggaaccgg

SEQ ID NO: 378447 - DNA, 542 bp, Homo sapiens
  misc_feature: GZ8MTXP02F5FYD.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgcttttgattatcgtggggccaaaggggacaatggtcacgtctcctcagcctcaccaacggcccatcggtcctccccctgccaccctcctccaagacgcacctccgtgggggcacgagccggcccgtgggctcgccgtggtcaaaggactacttccacgtgaagtcgactgagcggctggacg

SEQ ID NO: 378448 - DNA, 568 bp, Homo sapiens
  misc_feature: GZ8MTXP02GVGDL.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgtcttttgattatcgtggggccaagggacaagtggtcaccgtctcctcagcctccaccgaacgggccccagtccggtccttccccctcgggccacccctcctcccaacgacgccaccctcgtcgggggcacgacgccggcccgtggggcctcggccgtggtccaacggacctacgttcccacgtgaacgtcgactgacgcggcgtggacg

SEQ ID NO: 378449 - DNA, 517 bp, Homo sapiens
  misc_feature: GZ8MTXP02I671V.38.26.C04.1.454.CMB.2.raw
  modified_base (280)..(280): a, c, t, g, unknown or other
  modified_base (342)..(342): a, c, t, g, unknown or other
  modified_base (453)..(453): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgagagcctgggtcctcggtgaaggtccctgcaaggcttctggaggcaccttcagcacctatactttcagctgggtncgacaggcccctggacaagggcttgagtggatgggaggatccctccgatctttggcaaaccncacctacgcacacagttcccaggcagactcacgattaccgcgacgaatccacgagcacagtcacatggagatgagtagcctgagatcgtagacgacacggccgtgtattcngtgcgagaggcggggccaggggctcggtggtaacgtggtgtcgtttgatacgtcgtgggtaccg

SEQ ID NO: 378450 - DNA, 630 bp, Homo sapiens
  misc_feature: GZ8MTXP02HII39.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagaggaggggccaggggctcggtggtaacgttaggtgtcttttgattatcgtggggccaaagggacaagtggtcaccgtctcctcacgcctaccaccgtaacggcccacgtccggtcccttcccccgtcggtcccaccccgttccctacccgaaacgaccgcctacccgtcggtcgggggaccacgacggccggcccgtcggggcccgtcggtcccgtacgggtaccgaaacgggtacccttaaccgttcccgtaccggtacgaacgttccggaacgttcgggacggccggggccggttcggaaccgg

SEQ ID NO: 378451 - DNA, 527 bp, Homo sapiens
  misc_feature: GZ8MTXP02F8XHF.38.26.C04.1.454.CMB.2.raw
  modified_base (434)..(434): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgattatctggggccaaaggggacaatggtcaccgtctcctcagcctcaccaaggcccatcggtctccccngcaccctcctccaagagcacctcgtggggcacagcggccctgggctgcctggtcaaggactacttccacgtgaatcgactgagcggctggacg

SEQ ID NO: 378452 - DNA, 599 bp, Homo sapiens
  misc_feature: GZ8MTXP02H12KO.38.26.C04.1.454.CMB.2.raw
  modified_base (405)..(405): a, c, t, g, unknown or other
  modified_base (446)..(446): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgtcttttgattagtcgtggggccaaaggggacaagtggtcaccgtcncctcagcctccaccgaagggcccagtccggtccttcccccnggccaccccgtcctaccaacgacgccaccctcgtcgggggacacgacggtccggcccgtggggccctcggcccgtcgggtaccaaacggggacttacccgttacccgtacgtacggaacgttcggaaccgtaggcggcggggctcgggaccgg

SEQ ID NO: 378453 - DNA, 533 bp, Homo sapiens
  misc_feature: GZ8MTXP02JPHHK.38.26.C04.1.454.CMB.2.raw
  modified_base (491)..(491): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaaggcttgagtggatgggaggatcctcccgatctttggcaaaccacacctacgcacacaagtccaggcagactcacgattaccgcgacgaatccagacgcacagtctacatggagatgagtagcgtagagatctagacgacgacggccgtgtatttctgtgacgaggaggacgggggccgaggggcgtacggnggttacggtaaggtgtcgttttagatacgtcgtacgggacgg

SEQ ID NO: 378454 - DNA, 580 bp, Homo sapiens
  misc_feature: GZ8MTXP02G592I.38.26.C04.1.454.CMB.2.raw
  modified_base (282)..(282): a, c, t, g, unknown or other
  modified_base (421)..(421): a, c, t, g, unknown or other
  modified_base (464)..(464): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggcaccttcagcacctatactttcagctgggtncgacacggcccctggacaagggcttggagtggatgggaggactccctccgatcgtttggaccaaaccgcacctacgccacacaagttccaggacagactcacgactacgcgacaactccacgagcacagtcacatgganatgagtacgctgagatcagacgacgacggccgttgtatttcgngtcgacggtaggagggacgggggaccgaacgggggtccgttacggggtacgggtttaaaaccggttgggttcggttacgttttaggacgtttacgtcgggttacgggggtaaccgg

SEQ ID NO: 378455 - DNA, 536 bp, Homo sapiens
  misc_feature: GZ8MTXP02FTKFS.38.26.C04.1.454.CMB.2.raw
  modified_base (343)..(343): a, c, t, g, unknown or other
  modified_base (454)..(454): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatcctcccgatctttggcaaaccncactacgccacacaagttccaggacagctcacgattaccgcgacgaatccacgagcacagtctacatggagatgagtagcctgagatctgacgacacggccgtgtatttcngtgcgaggagagggggccagggggctcgggtcggtaacggttaggtagtcgtttgatactcgtggggtaccaaggggtaacg

SEQ ID NO: 378456 - DNA, 583 bp, Homo sapiens
  misc_feature: GZ8MTXP02G84ZR.38.26.C04.1.454.CMB.2.raw
  modified_base (278)..(278): a, c, t, g, unknown or other
  modified_base (451)..(451): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacacggccgtgtatttctgtgcgagaggaggggccaggggctcggtggtaacgttaggtgtcgttttgattatcgtggggccaaaggggacaagtggtcaccgtctcctcacgcctaccaccgaacgggcccagtccggtccttcccccgnggcccaccctccacctaagacgccacctcgtcggggcacgacggccggcccgtgggcctcggccgtggtccaaacggtacctaccgttccgacgtcgaacgtcgaacgtcggacggccgggcgtcggaccgg

SEQ ID NO: 378457 - DNA, 538 bp, Homo sapiens
  misc_feature: GZ8MTXP02FNSHD.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgattatctggggccaaaggggacaagtggtcaccgtctcctcagcctccaccaaggcccatcggtctcccctcggccaccctcctccaacgacgcacctcgtgggggcacgagcggcccgtgggctcgcctggtcaaggactactccacgtgaagtcgactgagcggctggacg

SEQ ID NO: 378458 - DNA, 567 bp, Homo sapiens
  misc_feature: GZ8MTXP02HTPYV.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagagaggggccaggggctcggtggtaacgttaggtgctttttgattatcgtgggggccaaaggggactaaagtcgggtcacccgtctcctcagccctccaccaacgggcccacgtccggtccttccccctcggccaccctcctaccaagacgccacctcgtcggggcacgacgccggcccgtgggctcgccgtggtacaacggactacgtccacgtgaacgtcgacgtgacgcggcgtcggacg

SEQ ID NO: 378459 - DNA, 581 bp, Homo sapiens
  misc_feature: GZ8MTXP02JEDIN.38.26.C04.1.454.CMB.2.raw
  modified_base (284)..(284): a, c, t, g, unknown or other
  modified_base (350)..(350): a, c, t, g, unknown or other
  modified_base (388)..(388): a, c, t, g, unknown or other
  modified_base (400)..(400): a, c, t, g, unknown or other
  modified_base (404)..(404): a, c, t, g, unknown or other
  modified_base (416)..(416): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatacttcagctgggtncgacacggcccctggacaagggcttgagtggatgggaggactcccgtccgatcgttggacaaaccncacctacgcacacagtccaggcagactcacgataccgngacaatccagancacngactacatgganatgagtagactgagatcgtagacgacgacggtccgtagtatttcgtgacgtacggaggagggacgggggtacgaacgggggtcgtacggggttacgggttaaacggttaacgggttggtaccgtttttacggaagtttacggttacggtacgggggtaaacccgg

SEQ ID NO: 378460 - DNA, 533 bp, Homo sapiens
  misc_feature: GZ8MTXP02GKRKG.38.26.C04.1.454.CMB.2.raw
  modified_base (418)..(418): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatggggaggactccgtcccgatctttggcaaaccacacctacgcacacagtccagcagactcacgataccgacggacgaatccacgagacacagtctacagtgganatgagtagcctagagatctagacgacgacggccgtgtatttcgtgtcgcgagaggagggccgagggcgtcggtaggtacggttaaggtgtcgtttgagtacgtcgtacgggtacg

SEQ ID NO: 378461 - DNA, 666 bp, Homo sapiens
  misc_feature: GZ8MTXP02H60KF.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaaagttccaggacagactcacgattaccgcggacgaatccacgagcacagtctacatggagatgagtagcctgagatctgacgacacggccgtgtattctgtgcgagaggaggggccaggggcgtcggtaggtaacgtttagggtgtcgtttttgagttacgtcgttagggggaccaaaggggaacctaaagtcggggtacctacccggtccttcccgcgtacgcccttacccgaacccgaaacggggcccctaacgttcccgggttccccttccccccgttacgggcccctaacccccttcccgtacccgaaacgacgaccctacccgttccggacgggggccaaccggcggcccggcccgtcggggccttcggcccgttgggtaccaaacgggtacctaccgttccgacgttacgaacgtcgaacgtgacggtcggcgtcggacgg

SEQ ID NO: 378462 - DNA, 582 bp, Homo sapiens
  misc_feature: GZ8MTXP02IKF28.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctggtggtaacgttggtgtcttttgattatcgtggggaccaaagggacaagtcggcaccgtctcctcacgcctccaccgaacggcccagtccggtccttcccccgcggccctacccctcctaccctaacgacgccaccctcgtcgggggcacgacgccgcccgtcgggctcggccgtggtaccaacgggtaccttaccgttcccacgtcgaacgtcgacgtcggacggccgggctacggacgg

SEQ ID NO: 378463 - DNA, 616 bp, Homo sapiens
  misc_feature: GZ8MTXP02H7KJX.38.26.C04.1.454.CMB.2.raw
  modified_base (320)..(320): a, c, t, g, unknown or other
  modified_base (421)..(421): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgattcgtttggcaaaccacactacgcacacaagttccaggacagactcacgattaccgcggacaatccacgagcacagtctacatggagatgagtagcctagagatctgacgacacggccgtgtatttcngtgcgaggaggagggggccaggggctacgggtggtaacgttaggtgtcttttgattatcggtaggggaccaaagggggacaagtcggtacaccgtctcccncacgccacccaccgacggaccgacgtccgtcccgttcccgtccgcctaccctaccctaccaacgacgaccgaccgtcggtcgggacgacgacggccggccgtcggtcgtcggtccggtcggtacgtaaacggtaaccgtaccgttaccgtacgtacgtaacgtacgtacgtacggacggcgggtcggtacggacg

SEQ ID NO: 378464 - DNA, 607 bp, Homo sapiens
  misc_feature: GZ8MTXP02JGECQ.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagagaggggccaggggctggtggtaacgttaggtgtctttgattagtcgtggggccaaggggacaagtcggtcaccgtctcctcacgcctccgaccgaacggcccacgtccggtccttcccccgtcggaccctacccctccctacccaacgacgaccgaacccgtcgtcgggggaccaccgacggccggccccgtcgggccgtcggccgtacggtacgaaacggtaccttaccgttaccgtacgtacgtaacgtcgaccgtcggacggtccgggcgtcggaccg

SEQ ID NO: 378465 - DNA, 576 bp, Homo sapiens
  misc_feature: GZ8MTXP02J14F5.38.26.C04.1.454.CMB.2.raw
  modified_base (435)..(435): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatacttcagctgggtgcgacacggcccctggacgaagggcttggagtggagtggggaggactccgtcccgattctttcgacaaaccacacctacgcacactagtccaggcagactcacgacttaccgacggacgaactacccgagacgacacagtactacagtggaanagtagagtacgccgtagagatcgtagacgacgacggtccgttagttactttcgtgtcgacggaggaggcgggggacgacgggggtcgtcggggtaggttaaacggttggtcgtcgtttagacgtacgtcggtacgggacgg

SEQ ID NO: 378466 - DNA, 531 bp, Homo sapiens
  misc_feature: GZ8MTXP02G1WBG.38.26.C04.1.454.CMB.2.raw
  modified_base (278)..(278): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacacggccgtgtatttctgtgcgagagaggggccaggggctcggtggtaacgttaggtgcttttgatatcgtggggccaagggacaagtggtcaccgtctcctcagcctcaccaagggcccatcggtctcccctgccaccctctccagacgcacctcgtggggcacgacgcggcccgtggctcgcctggtcaggactacttccacgtgaagtcgactgacgcggctggacg

SEQ ID NO: 378467 - DNA, 553 bp, Homo sapiens
  misc_feature: GZ8MTXP02HOASI.38.26.C04.1.454.CMB.2.raw
  modified_base (248)..(248): a, c, t, g, unknown or other
  modified_base (284)..(284): a, c, t, g, unknown or other
  modified_base (393)..(393): a, c, t, g, unknown or other
  modified_base (425)..(425): a, c, t, g, unknown or other
  modified_base (467)..(467): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaagggcttcnggaggcaccttcagcacctatactttcagctgggtncgacaggcccctggacaagggcttggagtggatggggagggatcccgtcccgatcgtttggacaaaccacacctacgcacacagttccaggcagactcacgataccggngacatcccgacgagcacgagtcacagtggaanatgagtagcctgagatcagacgacgacggcctgtactttcgngtgacgaggaggacggggcgacggggtcgtacggggtaggttaacggttggtcgttacgtttagagttacggtacggtacgggacg

SEQ ID NO: 378468 - DNA, 597 bp, Homo sapiens
  misc_feature: GZ8MTXP02JQX7Q.38.26.C04.1.454.CMB.2.raw
  modified_base (446)..(446): a, c, t, g, unknown or other
tcagtcgatcacgtcacgaccggtgctcgatttagtctagcgactttgggtttgggatggtttctcgatggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcgttttgatagtcgtgggggccaaaggggtacaagtgggtcacccgtctccgtcacgcctccacccgaagggcccatcggtcttcccccnggccaccctcctccaacgacgtccgaacctcgtcgggggaccacgacgccggcccgtcggggccttcggcccgtcgggtccaaacgggtccttaaccgttcccgaacgttcgaacgtccggaaccgtggacggccggggtcgtcgggaccg

SEQ ID NO: 378469 - DNA, 542 bp, Homo sapiens
  misc_feature: GZ8MTXP02JNQP7.38.26.C04.1.454.CMB.2.raw
  modified_base (347)..(347): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggcaccttcagcacctatactttcagctgggtgcgacaggcccctggacaagggcttggagtggatgggagggatccgtcccgatcgttggcaaaccnacctacgcacacagtccagcagactcacgataccgcgacgaatccacgagcacagtctacagtgacgatagagtagcctgagatcgtgacgacgacggtccgtgtatttcgtgtcggacgaggagggacgggggcgacggggtcgtcgggtaggtaacggttggtcgtcgtttgattacgtcggtgggtaaccgg

SEQ ID NO: 378470 - DNA, 595 bp, Homo sapiens
  misc_feature: GZ8MTXP02JW4GR.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggcgtgtatttctgtgcgagagaggggccaggggctcggtggtaacgttaggtgtcttttgattagtcgtgggggaccaaaggggacaagtggtccaccgtctcctcacgcctccaccgaacggcccagtccggtccttcccccgtcggccacccctcctcccgaagacgccaaccctcgtcgggggccacgacggccggcccgtggggccttcggccgtggtaccgaaacgggaccttaaccgtcctaacggtcgaacgttccgaacgtggacggccgggccgtggaccgg

SEQ ID NO: 378471 - DNA, 555 bp, Homo sapiens
  misc_feature: GZ8MTXP02I40FK.38.26.C04.1.454.CMB.2.raw
  modified_base (423)..(423): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaaggcttgagtggatggggaggatcccgtccgattcgttggcaaaccgcacctacgcacacagtccaggacagactacacgacttaccgcgacgaactccgacgagacacagtactacatgganatgagtagcctgagatcgtagaccgacgacggccgtagttatttcgtgtgcgaggagggacgggggccgagggggcgtacgggtaggtaacggttaaggtgtacgttttcgagttacgtcgtggggaaccgg

SEQ ID NO: 378472 - DNA, 566 bp, Homo sapiens
  misc_feature: GZ8MTXP02H1RIC.38.26.C04.1.454.CMB.2.raw
  modified_base (422)..(422): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggagtggggaggatcccgtcccgattcgtttggacaaaccgacactacgcacacagttccagcagactcacgacttaccgcgacgactccacgagcacagtctacatgganatgagtagcctagagatctagacgacacggccgtgttactttcgagtgacggaggtaggacgggggcccgaagggggtcgtcggggttaggtaacggttaagggtcgtacgttttggaagttacgttcgttacgggggaaccgg

SEQ ID NO: 378473 - DNA, 531 bp, Homo sapiens
  misc_feature: GZ8MTXP02HRI0J.38.26.C04.1.454.CMB.2.raw
  modified_base (454)..(454): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggagggatcctccgatcttggcaaacacacctacgcacacagtccaggcagactcacgataccgcgacgatccagacgcacagtctacatggagatgagtagcctagagatctagacgacgacggccgtgtatttcgngcgcggaggaggacggggcgacggggcgtcgggtaggtacggttaaggtcgtacgtttgagtcgtcggtacgggacg

SEQ ID NO: 378474 - DNA, 606 bp, Homo sapiens
  misc_feature: GZ8MTXP02FXX5C.38.26.C04.1.454.CMB.2.raw
  modified_base (418)..(418): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaaggcttgagtggatgggagggatccctcccgatctttggctaaaccacacctacgcacacaagttccaggcagactcacgattaccgcgacgaatccacgagacacagtcacatgganatgagtagcctgagatcgtagaaccgacgaaccgggccgttagttaactttccgtggtcggacggtaagggacggggacggggggacccgtaaggggggtccgttaccgggggttagggtttaaaaccgggtttaaggggttcggttccgtttttaggagtttacgtacgggtcgggggtaaacccgg

SEQ ID NO: 378475 - DNA, 554 bp, Homo sapiens
  misc_feature: GZ8MTXP02HKCXQ.38.26.C04.1.454.CMB.2.raw
  modified_base (346)..(346): a, c, t, g, unknown or other
  modified_base (421)..(421): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacaggcccctggacaagggcttgagtggagtgggagggatccgtccgatcttggacaaaccncacctacgcacacaagttccaggacagactcacgacttaccgcgaacgaatccacgagcaacagtctacatgganatgagtagcctagagatctagacgacgacggccgtagtacttctagtcgacgaggaggacgggggccgaaggggcgtacgggtaggtaaacggttggtgtacgttttagagttagtcggttacggggaaccgg

SEQ ID NO: 378476 - DNA, 700 bp, Homo sapiens
  misc_feature: GZ8MTXP02INZGR.38.26.C04.1.454.CMB.2.raw
  modified_base (574)..(574): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctcggtgaacggtcccctgcaaggcttcgtggaggctaccttcagcaccttatactttcagtcgtgggtgcgaccacggccccctaggaccgaagggcttggaggtggaagtggggaggactccccgtccgtattcgttcggaccaaaaccgccaacctaccgaccacaacgtaacgttcccaaggaccacgtactaccgaacgtacgttacccggacggtaaaccgaacgtacccgacggacgacgacgtacgtactaccgaggttagggaagtagtaggaaagtaccgtccgtaggaacgtaacgttcggtaacggacccggtacgaaccgggttccgttagttacgtttcgnggttacggacggtagggtaacgggcgggggtaccggagggggtccggttaccggggttaggggttaacggtttaagggtcgtttacgttttaggaacgtttacggtccgggtaggggtaaacccgg

SEQ ID NO: 378477 - DNA, 535 bp, Homo sapiens
  misc_feature: GZ8MTXP02H4BY9.38.26.C04.1.454.CMB.2.raw
  modified_base (463)..(463): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccccgatctttggcaaaccacactacgcacacaagttccaggacagactcacgattaccgcggacgaaatccacgagcacagtctacatggagatgagtagcctgagatctgacgacacggccgtgtattctgtgcgagagaggggccaggggctcggtgtaacggttaggtgcttttgattatcgtggggccaaaggggacaaagtggtcacccgtctcctcagcctccaccaaaggcccatcgtcctcccctgcaccctcctcaagacgcaccnctggggcacgagccggcctgggctgcctggtcaaggactactccacgtgaagtcgactcgagcggtcgcgcg

SEQ ID NO: 378478 - DNA, 609 bp, Homo sapiens
  misc_feature: GZ8MTXP02HA2F8.38.26.C04.1.454.CMB.2.raw
  modified_base (282)..(282): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttcgtggaggcaccttcagcacctatacttcagctgggtncgacacggcccctggacaagggcttggagtggagtggggagggactccgtccgattcgttggacaaaccgacaccctacgcaacacaacgttccaggcacgactccaacgtacttaacccggcggtaacgaactacccgaacgacgaccaacacgtactaccagtcgggaatagtgaagtacgccgtagtaagactcgtagaaccgacgacggccgttagttactttcgtgtcgacggaggagggcgggggaccggtagggggccgtcgggtaggttaacggtggttacgtcgttttaggacttacggtacggtacggggtaaccgg

SEQ ID NO: 378479 - DNA, 542 bp, Homo sapiens
  misc_feature: GZ8MTXP02I3P9X.38.26.C04.1.454.CMB.2.raw
  modified_base (346)..(346): a, c, t, g, unknown or other
  modified_base (370)..(370): a, c, t, g, unknown or other
  modified_base (415)..(415): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacacggcccctggacaaggcttgagtggatgggaggatccctcccgattctttggcaaaccncacctacgcacacagttccaggcngactcacgataccgcgacaactccacgagcacagtctacatgganatgagtagctgagatctagacgacacggcgtgtattcgtgtcgacggagaggacgggggccgaagggggtcgtacgggtggttaaacggttgggtgttacgttttgagttacgtcgtcggggaaccg

SEQ ID NO: 378480 - DNA, 621 bp, Homo sapiens
  misc_feature: GZ8MTXP02J4QEI.38.26.C04.1.454.CMB.2.raw
  modified_base (284)..(284): a, c, t, g, unknown or other
  modified_base (410)..(410): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggcttctggagcaccttcagcacctatacttcagcgtgggtncgacacggcccctggacaagggtcgttgagtggagtggggaaggctcctacccgatcgttgaaccaaaccacaccacgcacacagtccaggcagactcacgataccgacggaacaatcccgaaganaccaacagttaccagagtggaagataggagtacgcctaggaacgtactcgacgaccgaccggtaccggtcgttagttacgttcgtagggtacggacgggaaggggacggggtacgggggaccggtacgggggtcggttacggggttaacgggtttaacggttcgggttacgttacgtttacggtaagtacggtacgggtacggggaaccgg

SEQ ID NO: 378481 - DNA, 534 bp, Homo sapiens
  misc_feature: GZ8MTXP02I9ARY.38.26.C04.1.454.CMB.2.raw
  modified_base (344)..(344): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcaccctatactttcagctgggtgcgacaggcccctggacaagggcttgagtggatggggaggatccgtccgatctttggcaaaccncactacgccacacaagtccagacagctcacgattaccgcgacgaatccacgagcacagtctacatgagatgagtagcctgagatcgtagacgacacggccgtagtactttcgtgtgacgtaggagacgggggcagggggctcgggtggtaacgttggtgtcgtttgatagtcgtcgggaccgaaggtacg

SEQ ID NO: 378482 - DNA, 609 bp, Homo sapiens
  misc_feature: GZ8MTXP02HNINP.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagagaggggccaggggctcggtggtaacgttaggtgtcttttgatatcgtggggaccaaagggacaagtcggtcaccgtctccctcacgccctccacccgaacgggcccacgtccggtccttccccccgtggcccacccccttcctacccaaacgacgcccacccgtcgtcgggggacaacgcggccggccccgtgggcctcggcccgttgggtaccgaaacgggtaccttaccgttacccgacggttacgaacgttcgaaccgtgacggcgggtcgtacggaccgg

SEQ ID NO: 378483 - DNA, 577 bp, Homo sapiens
  misc_feature: GZ8MTXP02IZ59U.38.26.C04.1.454.CMB.2.raw
  modified_base (282)..(282): a, c, t, g, unknown or other
  modified_base (420)..(420): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtncgacaggcccctggacaaggcttgagtggagtgggagggactccgtccgatcgtttggacaaaccacacctacgcacacagtccagcagactcacgactaccgcgacaatcccaagacgcaacagtactacatagganagtgaagtagaccgtagacgattacgagacgacgtacggccgttagttactttcgtgtcggacgaggacgggacgggggccgaagggggtccgtacggggtagggttaaacggttgggttgtcgttttaggattacggtcggttacgggggaaccgg

SEQ ID NO: 378484 - DNA, 571 bp, Homo sapiens
  misc_feature: GZ8MTXP02HZIZW.38.26.C04.1.454.CMB.2.raw
tcagtcgatcacgtcacgaccggtgctcgatttagtctagcgactttgggtttggggatggttttctcgatggggactgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcgggtggtaacgttaggtgcttttgattatcgtggggccaaggggacaagtggtcaccgtctcctcacgcctccaccaacgggcccatccgtccttccccctggccacccctccctcccaacgacgccacctccgtcgggggcacgacggccggcccgtgggccttcggccgttggtcaaacgggactacgttccacgtgaacgtccgactcgacggcgggctcggacg

SEQ ID NO: 378485 - DNA, 534 bp, Homo sapiens
  misc_feature: GZ8MTXP02I6VRB.38.26.C04.1.454.CMB.2.raw
  modified_base (340)..(340): a, c, t, g, unknown or other
  modified_base (409)..(409): a, c, t, g, unknown or other
  modified_base (411)..(411): a, c, t, g, unknown or other
  modified_base (452)..(452): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagaagcctggtcctcggtgaaggtcccctgcaaggcttcgtggaggcaccttcagcacctatacttcagctgggtgcgacaggcccctggacaagggcttgagtggatgggaggatcctccgatcttggcaaacncactacgcacacagtcccagcagactcacgataccgcgacgaactccgacgagcacagtctacatgganangatagcctgagatctagacgacgacggccgtagtacttcgngtgcggaggaggacgggggccgaggggtcgtacgggtggtaacgttggtcgtacgttttggagttacgtcggtcgggtaacg

SEQ ID NO: 378486 - DNA, 519 bp, Homo sapiens
  misc_feature: GZ8MTXP02FVGYK.38.26.C04.1.454.CMB.2.raw
  modified_base (282)..(282): a, c, t, g, unknown or other
  modified_base (413)..(413): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtncgacaggcccctggaccaagggcttgagtggatgggaggatcctccgatcttggcaaaccacacctacgcacacaagttccagcagactcacgattaccgcggacaatccgacgagcacagtctacatganatgagtagcctgagatcgtgacgacacggcctgtattctgtgacgagaggacgggggcaggggctcgggtgtaacggtaaggtgtctttgatagtcgtgggtaccg

SEQ ID NO: 378487 - DNA, 580 bp, Homo sapiens
  misc_feature: GZ8MTXP02GFMUK.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgtcttttgattatcgtggggccaaagggacaagtggtccaccgtctcctcagcctccaccaacgggcccagtccgtccttcccccgcggccacccctcctccaacgacgcacctccgtgggggccacgacgccggcccgtgggccgtcgcccgtggtaccgaaacggaccttaccttccgaacgttgaacgttcgaacgtggacggcggcgtcggaaccgg

SEQ ID NO: 378488 - DNA, 574 bp, Homo sapiens
  misc_feature: GZ8MTXP02HHAVR.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgtcttttgattatcgtggggaccaagggacaagtgacaccgtctcctcacgcctcaccgacggcccatccggtcctccccgtcggccaccctcctccaagacgcacctcgtcgggggccacgacgccggcccgtcgggctcggccgtcggtaccgaaacgggaccttaccgttaccgacgtcgaacgtcgacgtcggacggccggcgtcggaccgg

SEQ ID NO: 378489 - DNA, 585 bp, Homo sapiens
  misc_feature: GZ8MTXP02HRR95.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggaggggccaggggctcggtggtaaacgttaggtgtcttttgattatcgtggggaccaaaggggacaagtggtcaccgtctcctcacgcctccaccgaacggcccagtccggtcctcccccgtggccaccctccctaccaagacaccaccgtcgacgggggccacgacggccggcccgtcgggcgtcgccgtgggtaccaaacgggtacctaccgttccgtacgtgaacgtcggaacgtcgacggccgggcgtcggacg

SEQ ID NO: 378490 - DNA, 525 bp, Homo sapiens
  misc_feature: GZ8MTXP02IM7Y9.38.26.C04.1.454.CMB.2.raw
  modified_base (330)..(330): a, c, t, g, unknown or other
  modified_base (445)..(445): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgagagcctggtctcgtgagtccctgcagctctgagcactcagcacctatacttcagctgggtgcgacaggcccctggacaagggcttgagtggatgggaggatccgtcccgatctttggcaaaccncacctacgcacacaagttccagcagactcacgacttaccgcggacgaatccacgagcacagtctacatggagatgagtagcctgagatctagacgacacggccgtagtatttcgngtgcgtaggaggacgggggccgagggggccgtacgggtggtaacggttaaggtgtcgttttgagttagtcgtagggaccg

SEQ ID NO: 378491 - DNA, 580 bp, Homo sapiens
  misc_feature: GZ8MTXP02JA7SL.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcatcatggactggacctggaggttcctctttgtggtggcagcagctacaggtgtccagtcccaggtgcagttggtgcagtctggggctggaggtgaagaagcctgggtcctcggtgaaggtcccctgcaaggcttcgtggaggcaccttcagcacctatactttcagctggtgcgacgacggcccctggacaagggcttggagtggagtggggaggactccgtccgattcgttggaccaaaccaccactacgcaacacaacgttccaggacagactcacgactaccgcgaacactccacgacgcacagtctacagtggagagtagagtagcctagagtatcgtagacgacgacggtccgtgtactttcgagttcgacggtaggacgggacgggggccgtagggggccgttacggggtagggttaaccggttagggtcggttacgttttggattacggtcggtacggggg

SEQ ID NO: 378492 - DNA, 560 bp, Homo sapiens
  misc_feature: GZ8MTXP02GGZMX.38.26.C04.1.454.CMB.2.raw
  modified_base (400)..(400): a, c, t, g, unknown or other
  modified_base (431)..(431): a, c, t, g, unknown or other
  modified_base (475)..(475): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggagcaccttcagcacctatactttcagctgggtgcgacacggcccctggacaagggcttggagtggagtggggagggactcccgtcccggattcgtttggaccaaaccacacctacgcacacaagttcccaggcagactcacgattacccgngaaccaatccacgagcacagtctacatgganatagagtagcctagagatcgagaccgacacggccgtgtattcgngtgcgaggaggacgggggccgagggggcgtcgggtaggttaacggttaaggtcgtcgttttagattacgtacggtcggggaaccg

SEQ ID NO: 378493 - DNA, 567 bp, Homo sapiens
  misc_feature: GZ8MTXP02G3VPR.38.26.C04.1.454.CMB.2.raw
  modified_base (326)..(326): a, c, t, g, unknown or other
tcagtcgatcacgtcacgaccggtgctcgatttagtctagcgactttgggtttggggatggttttctcgatgggggctgggaggcgttgttggagaccttgcacttgtactccttgccattcagccagtcctggtgcaggacggtgaggacgctgaccacacggtacgtgctgttgtactgctcctcccgatctttgacaaaccacactacgcacacaagttccaggacagactcacgattaccgcggacaatccacgagcacagtctacatggagatgagtagcctgagatctgacgacacggccgtgtattctgtgcgagaggnggggccaggggctcggtggtaacgttaggtgtcttttgattagtcgtggggaccaaggggacaagtggtcaccgtctcctcacgcctccaccgaacgggcccactccggtcccttcccccgtggcccaccctcctccaaacgcgccaccgtcgcgggggccacgcgccggcccgtgggccgtcgccgtggtacgaggacctacttccgacgtgaacgtcgacgtggacgcggcgtcggacg

SEQ ID NO: 378494 - DNA, 558 bp, Homo sapiens
  misc_feature: GZ8MTXP02IFNH3.38.26.C04.1.454.CMB.2.raw
  modified_base (402)..(402): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagaggaggggccaggggctcggtggtaacgttaggtgcttttgatatcgtggggcaaggggacagtggtcaccgtctccncacgcctccaccaacggcccagtcggtcctccccctggccaccccgtccctccgaacgcgacaccctcgtcgggggcacgacgccggcccgtgggctcgccgtggtccaaacgggactacgtcctacgtgaacgtcgactggaggcggcgtggacg

SEQ ID NO: 378495 - DNA, 617 bp, Homo sapiens
  misc_feature: GZ8MTXP02JHF0A.38.26.C04.1.454.CMB.2.raw
  modified_base (352)..(352): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatacttcagctggtgcgacacggcccctggacagggcttggagtggagtggggaggactcccgtccgattcgttggacaaaccncacctacgacacacagtccagacagactacacgacttacccggacggaacaaactcccgaacgacgaccaacgtacgtactaaccagtacgggaagagtacgaagtacgccgtaggagacttcgagaaccgacgaccgggtccgttagttactttcgtgtcggacggaggacggggacgggggccgaagggggtccgttacggggtacggttaaacggttgggtcgttacgttttaggacgttacggtcggtacggggtaaccgg

SEQ ID NO: 378496 - DNA, 524 bp, Homo sapiens
  misc_feature: GZ8MTXP02HSZ6U.38.26.C04.1.454.CMB.2.raw
  modified_base (455)..(455): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtgcgacaggcccctggacaaggcttgagtggatgggaggatcctccgatcttggacctaaacacacctacgcacacagttccaggcagactacacgataccgcgaccgaatccacgagacactagtctacatggagatcgagtagcctgagatctgacgacacggcgtgtattcngtgcgaggaggaggggccgagggcgtcggtggtaacgtaaggtgtacgtttgagtacgtcgtgggaacg

SEQ ID NO: 378497 - DNA, 528 bp, Homo sapiens
  misc_feature: GZ8MTXP02H9M7L.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaagggcttctggaggcaccttcagcacctatacttcagctgggtgcgacaggcccctggacaagggcttgagtggatgggaggatcctcccgatctttggcaaaccacacctacgcacacaagttccaggcagactcacgataccgagacgaactaccacgagcacagtctacatagagatagagtagcctgagatctagacgacacggcgtgtattctgtgtcgagaggacgggccgagggcgtcggtagtacggttaaggtcgtcgtttgatacgtcgtacgggtacg

SEQ ID NO: 378498 - DNA, 633 bp, Homo sapiens
  misc_feature: GZ8MTXP02G75LB.38.26.C04.1.454.CMB.2.raw
  modified_base (282)..(282): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtncgacacggcccctggacaagggcttgaggtggagtgggaggactcccgtccgatcgtttaggaccaaaccacacctacgccacaacaacgttccaaggcagacctacgacgtactacccggacggtaaaccgaaactcccaaacgacgacacaacgtcctaacacgtaggaagataggaagtacgaccgtagaagtactacgtacggacgacaccgggtccgtacgttatttcgagtcgacggaggagggacgggggtacccgagggggtaccgttacggggttaacggggttaaacggttaagggttcggtacgtttttaggaagtttacggtcgggtacggggtaacgg

SEQ ID NO: 378499 - DNA, 587 bp, Homo sapiens
  misc_feature: GZ8MTXP02HGPDP.38.26.C04.1.454.CMB.2.raw
  modified_base (302)..(302): a, c, t, g, unknown or other
  modified_base (325)..(325): a, c, t, g, unknown or other
  modified_base (431)..(431): a, c, t, g, unknown or other
  modified_base (465)..(465): a, c, t, g, unknown or other
  modified_base (536)..(536): a, c, t, g, unknown or other
  modified_base (561)..(561): a, c, t, g, unknown or other
tcagtcgatcacgtcacgaccggtgctcgatttagtctagcgactttgggtttggggtagtggttttcttcgatgggggcgtgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtacgcctgagatccngacgacacggtctgtatttctgngacgagaggacggggccaggggtctcggtagggtaacgttaggtgtcctttttagattagtccgtgggggcaaaggggtacaagttggcaccgtctctacacgccnccaccgaacggccctagtccggtccttcccccgnggcccaaccccttccacccgaagacgccaccgttcgcgggggcaaacgcggccgcccgtgggcttcggccnggtacaaaggctaccgttccacgtnaacgcgcgtgacgcggcgttgaacgg

SEQ ID NO: 378500 - DNA, 596 bp, Homo sapiens
  misc_feature: GZ8MTXP02JN1VW.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctcggtgaaggtcccctgcaaggcttcgtggaggcaccttcagcacctatactttcagcgtgggtgcgacacggcccctggacgaagggcttggaggtggagtggggaggactcccgtcccgtatcgtttacggacaaaaccgtcacctacgcacaactagtaccaggacacgactacacgattaccgacggacgaaactcccaagacgacacgacgtactacagtagagatgagtgaccgtagagactcgtagaacgtacgacggtccgtagttacttcgtgtgacggaggtacgggacgggggacgtacggggacgtcgggtagggttaacggtaaggtcggttacgttttagagttacgtcggtacggggaaccgg

SEQ ID NO: 378501 - DNA, 551 bp, Homo sapiens
  misc_feature: GZ8MTXP02IF5WA.38.26.C04.1.454.CMB.2.raw
  modified_base (282)..(282): a, c, t, g, unknown or other
  modified_base (349)..(349): a, c, t, g, unknown or other
  modified_base (413)..(413): a, c, t, g, unknown or other
  modified_base (441)..(441): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttcgtggaggcaccttcagcacctatactttcagctgggtncgacaggcccctggacaagggcttgagtggatggggaggatcccgtcccgatcgtttggaccaaacncactacgcacacattccaggcagactcacgactacgcgacgatcacaagcacagtctacatganatgattacgcctgagatctagaccgtanacggccgtgttatttcgagttcgagacgagggacggggaccgaagggggtctacggggtgtaaacggttaaggtcgtacgttttcggaattcgtcggttacgggaaccgg

SEQ ID NO: 378502 - DNA, 554 bp, Homo sapiens
  misc_feature: GZ8MTXP02I8MCV.38.26.C04.1.454.CMB.2.raw
  modified_base (418)..(418): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaaggcttggagtggagtgggagggatcccgtcccgattcgttggacaaaccacactacgcacacacgtccagcagactcacgtataccgcgacaatccacgagcacagtctacagtganatgagtagcctagagatcgagacgacgacggccgtagtattctagtgacggaggagggcgggggaccgagggggtctacggggtaggtaaacggttgggtcgttacgttttaggagttagtcggtacggggaaccg

SEQ ID NO: 378503 - DNA, 527 bp, Homo sapiens
  misc_feature: GZ8MTXP02IQYMG.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgatatcgtggggccaagggacaatggtcaccgtctcctcagcctcaccaagggcccatcggtctccccctggccaccctcctccagacgcacctcgtcgggggcacagcggcctgggctgcctggtcaaggctactcacgtgaatcgacgtgagcggctggcg

SEQ ID NO: 378504 - DNA, 546 bp, Homo sapiens
  misc_feature: GZ8MTXP02JAKA3.38.26.C04.1.454.CMB.2.raw
  modified_base (346)..(346): a, c, t, g, unknown or other
  modified_base (461)..(461): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacaggcccctggacaagggcttgagtggatggggagggatccgtccgatcgttggcaaaccncacctacgcacacagttccaggcagactcacgattaccgacgacaatccacgagcacagtctacatgagatgagtagcctagagatcgtagacgacgacggccgttgtatttcgngtgtcgagaggcgggggacgagggggctcggggtaggtaacggttaagggtgtacgttttggattacgtcggtacggggtaaccg

SEQ ID NO: 378505 - DNA, 527 bp, Homo sapiens
  misc_feature: GZ8MTXP02IC4SC.38.26.C04.1.454.CMB.2.raw
  modified_base (282)..(282): a, c, t, g, unknown or other
  modified_base (343)..(343): a, c, t, g, unknown or other
  modified_base (375)..(375): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtncgacaggcccctggacaagggcttgagtggatgggaggatccctccgatcttggcaaaccncacctacgcacacagttccagcagactcacgntaccgcggacaatccacgagcacagtctacatggagatgagtacgcctgagatctagacgacacggccgtgtatttctgtgcgagaggacgggggccagggtcgacgtcggtggtaacgttgggtgtcgtttaggacttagtcggtacgggg

SEQ ID NO: 378506 - DNA, 599 bp, Homo sapiens
  misc_feature: GZ8MTXP02JCANL.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagaagcctgggtcctcggtgaacggtcccctgcaaggcttctggaggcaccttcagcacctatacttcagctgggtgcgacacggcccctggacaagggcttgagtggagtggggaggactcccgtcccgattcgtttggaccaaaccacacctacgcacacagttccagacagactcacgacttaccggacgaacgaactcccgaacgacgacaacgagtacctacagtacggagagtgaagtacgccgtagagacttcgtagaccgacgacggccgttagttactttcgtgtcggacgaggagggacgggggccgacggggtccgtacgggtggttaaacggttaagggttgttacgttttaggagtttacgtacggtacggggtaaccg

SEQ ID NO: 378507 - DNA, 533 bp, Homo sapiens
  misc_feature: GZ8MTXP02I611Q.38.26.C04.1.454.CMB.2.raw
  modified_base (340)..(340): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgagagcctgggtcctcggtgaaggtcccctgcaaggcttctggaggcaccttcagcacctatactttcagctgggtgcgacaggcccctggacaagggcttgagtggatgggaggatcctccgatcttggcaaacncactacgcacacagtccagcagactcacgacttacgcggacgaatccacgagcacagtctacatgagatgagtagcctgagatctagacgacgacggccgtgtatttcgtgtgacggagaggacgggggccagggggctacggggtggtaacggttaaggtgtcgttttagagttacgtcggtaggggtaccg

SEQ ID NO: 378508 - DNA, 553 bp, Homo sapiens
  misc_feature: GZ8MTXP02GDRBD.38.26.C04.1.454.CMB.2.raw
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttcngtgcgagaggaggggccaggggctcggtggtaacgttaggtgtcttttgatatcgtggggccaaaggggacaagtggtcaccgtctcctcacgcctccaccaacgggcccatccggtctccccctggcaccctcctccaagacgcacctcgtcgggggcacgacgccggccgtcgggctcgccgtggtccgaaaggtacctacgttccacgtgaagtcgactgacgcggctggacg

SEQ ID NO: 378509 - DNA, 587 bp, Homo sapiens
  misc_feature: GZ8MTXP02GUSIZ.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgcttttgattatcgtggggaccaagggacaagtggtcaccgtctcctcacgcctccaccgacgggcccatccggtcctccccctggccacccctcctccaacgacgccacctcgtcgggggccacgacggccggcccgtggggcctcggcccgtgggtccgaaacgggacctaaccttcccgaacgttcgaacgttccggacgttcggacggccgggaccgtggaccg

SEQ ID NO: 378510 - DNA, 556 bp, Homo sapiens
  misc_feature: GZ8MTXP02GAV3T.38.26.C04.1.454.CMB.2.raw
  modified_base (345)..(345): a, c, t, g, unknown or other
  modified_base (416)..(416): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatggggaggatcctccgattcttggcaaaccncacctacgcacacaagtccaggcagactcacgataccgcgacaatccacgagcacagtacacatcggagangaagtagcctagagatctagaccgacgacggccgtgtagttctgtcgacggagagggacgggggccgaggggtccgtacggggtacggttaacggttaaggtagtcgtttttacgagttacgtcggtcggggtaaaccgg

SEQ ID NO: 378511 - DNA, 668 bp, Homo sapiens
  misc_feature: GZ8MTXP02IUVSP.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctagagtatcgtgacgacgacggtccgtgttatttcgtgtgacgaggaggacggggccgaggggcttcgggtacggtaaacggttaggtgtcttttgagttacgtcggtcgggggaccaaaggggacaagtcggtacacccgtctccgtcgacgccctaccgaacccgaacgggcccagtcccggtcccttacccccgtcggacccctaccccgtccctaccgaacgacccgtaccgacccgtcgggacggggaccacggacggcccgggtcccgtcggggcccgttcggcccggttagggtacctaaaccgggtaccttacccgtacccgtacgtacggaacgttacggcgtacgggacggtccgggacgtcggaaccgg

SEQ ID NO: 378512 - DNA, 572 bp, Homo sapiens
  misc_feature: GZ8MTXP02HH4LI.38.26.C04.1.454.CMB.2.raw
  modified_base (476)..(476): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatacttcagctgggtgcgacaggcccctggacaagggcttggagtggatggggagggactcccgtcccgatcgtttggacctaaaccacacctacgcacacaacgtccaggacagactcacgataccgacggacaactccacgagcacagtctacatggagatgagtagcctagagatcgtagacgtacgacggtccgtagttactttcgngtgcggaggacggacgggggccacgggggtctacggggtacggttaacggttaaggtcgtacgttttaggacgttacgtcgggtacggggaaccgg

SEQ ID NO: 378513 - DNA, 603 bp, Homo sapiens
  misc_feature: GZ8MTXP02G7UST.38.26.C04.1.454.CMB.2.raw
  modified_base (430)..(430): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaacggtcccctgcaaggcttcgtggaggcaccttcagcacctatactttcagctgggtgcgacacggcccctaggacgaagggcttggagtggagtggggaggactcccgtccgatcgtttggacaaaccacacctacgcacactaagtccaggacacgactcacgactaccgacgacgaactaccacgagacacagtactacagnggtaagagtagagtacgccgtagagtatcgtagaaccgacggaccggtcgtaggttactttcgtggttcgacggagggagggacgggggaccgacgggggtcgttaccggggtaggttaaccggtttaaggtggttacgttttacggagttacggtcggtacgggtaaccggg

SEQ ID NO: 378514 - DNA, 557 bp, Homo sapiens
  misc_feature: GZ8MTXP02HSTUW.38.26.C04.1.454.CMB.2.raw
  modified_base (422)..(422): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagaagcctgggtcctcggtgaaggtcccctgcaaggcttctggaggcaccttcagcacctatactttcagctgggtgcgacacggcccctggacaagggcttggagtggagtgggagggatctccgatctttggcaaacacacctacgcacacagttcccaggcagactcacgactaccgacgacgaatcccgacgacgacacagtctacatagganatgaagtgcctgtagattacgcgacgaccacggtcccgtggtaatttcgtcgcgcgtaggaggacgggggcgacgggggctacgggtaggtacggttaaggtgtacgttttggattacgtcggtggggtaacccg

SEQ ID NO: 378515 - DNA, 593 bp, Homo sapiens
  misc_feature: GZ8MTXP02JPQ2S.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttctggaggcacttcagcacctatacttcagctgggtgcgacaggcccctggacagggcttggagtggagtgggagggactccgtccgattctttggacaaacctacaccctacgcacacaagttccaggacagactcacgacttacgcgacgaactccacgagcacagtctacagtaggagagtgagtacgaccgtgaagacttcgagaccgacacgggtccctaggttactttcgtgtcggtacgagggagggacgggggcccgtaagggggccgttcgggggtaggttaaaccgggtttgggtacggttccggttttaggacgttacggttcggtagggggtaacccgg

SEQ ID NO: 378516 - DNA, 553 bp, Homo sapiens
  misc_feature: GZ8MTXP02IBALC.38.26.C04.1.454.CMB.2.raw
  modified_base (343)..(343): a, c, t, g, unknown or other
  modified_base (416)..(416): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacaggcccctggacaagggcttgagtggatgggagggatcctccgatcttggcaaaccncacctacgcacacaagttccaggcagctacacgattaccgcggacaaactccacgagcacagtctacatgganatgagtagcctgagatcgtagacgacacggccgtgtatttctgtgacggagagggacgggggaccagggggcttacggggtcggttaacggttaagggtggttacgttttggagttacgtcggtacggggtaaccgg

SEQ ID NO: 378517 - DNA, 534 bp, Homo sapiens
  misc_feature: GZ8MTXP02H0HDN.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagaagcctgggtcctcggtgaaggtcccctgcaaggcttctggaggcaccttcagcacctatactttcagctgggtgcgacaggcccctggacaagggcttgagtggatgggagggatctcccgatctttggcaaacacacctacgcacacagttccaggcagactcacgataccgcggacactcacgagcacagtctacatgagatgagtagcctgagatctgacgacacggccgtgtatttctagtcgcgaggacggacgggggccgagggggccgtacgggtaggttacgttaaggtcgtcgttttgattagtcgttaggggaccg

SEQ ID NO: 378518 - DNA, 619 bp, Homo sapiens
  misc_feature: GZ8MTXP02FQQK1.38.26.C04.1.454.CMB.2.raw
  modified_base (257)..(257): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaggtcccctgcaaggcttcgtggagcaccttnagcactatacttcagcgtgggtgcgacgacggcccctaggacaagggcttggagtggagtggggaggtactcccgtccgtattcgttacggacaaaccgacacctaccgcaacactaacgttaccaggcacgactacacgtattaccgcggaaccgaactcccgaacgagaccgaacacgtactacagtacggagagtgaagtacaccgttagagtactacgtacggacgaccgtacggtccggttagttagtttccgtaggttcggacggaggagggacgggggaccggaggggtccgttacgggtaggttaacggttaaggttgttacgtttagagttcggtacggtacggggtaaccgg

SEQ ID NO: 378519 - DNA, 553 bp, Homo sapiens
  misc_feature: GZ8MTXP02GXV5S.38.26.C04.1.454.CMB.2.raw
  modified_base (348)..(348): a, c, t, g, unknown or other
  modified_base (415)..(415): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttggagtggatggggagggatccgtccgatcttggacaaaccncacctacgcacacagtccaggcagactcacgataccgcgacgatccacgagcacagtctacatgganatgagtacgcctgagatcgagacgacacggtcctagttattcgagtcgacgaggaggacgggggccaggggtcgtacgggtaggtaacggttaagggtcgttacggttttaggagttacgtcggtacggggaaaccgg

SEQ ID NO: 378520 - DNA, 580 bp, Homo sapiens
  misc_feature: GZ8MTXP02IP2IV.38.26.C04.1.454.CMB.2.raw
  modified_base (279)..(279): a, c, t, g, unknown or other
  modified_base (443)..(443): a, c, t, g, unknown or other
  modified_base (490)..(490): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagcctgggtcctggtgaacggtcccctgcaaggcttcgtggaggcaccttcagcacctatacttcagctggncgacacggcccctaggacaggcttggagtggagtgggaggacttccgtcccgatccgtttcggactaaaccgacaccctaccgacacactaacgttaccaggcacgactcgacgactaccggacgaacgacgtccgcgacgcgacagtacctacgagtcgaagngtagagtaacgcctagagatcgagacgacgacgtcgtagtactttgngtcgcggtaggagggcggggaccgaggggtcgtacgggttaggttaacgttaaggtcgtacgtttacgagtttagtcggtacgggaacgg

SEQ ID NO: 378521 - DNA, 597 bp, Homo sapiens
  misc_feature: GZ8MTXP02GG9DS.38.26.C04.1.454.CMB.2.raw
  modified_base (351)..(351): a, c, t, g, unknown or other
  modified_base (431)..(431): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacacggcccctggacaagggcttgagtggagtggggaggactccgtcccgattcgttgacaaaccncacctacgcacacagttccagacagactacacgacttaccgacgacgaactccgacgagacacagtctaacagtacgganagtagaacggtacgccgtagagtagtcgtagacgaacacgacggtccgtagttatttcgtagtcggacgaggacggggacgggggaccgtacgggggtaccgttcgggggttaggttaaaccggtttggtacgttcggttttaggatttacggtacggtacggggg

SEQ ID NO: 378522 - DNA, 599 bp, Homo sapiens
  misc_feature: GZ8MTXP02GB548.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcgggtggtaacgttaggtgtcttttgattatcgtggggccaaaggggacaagtggtacaccgtctcctcacgcctacccaccgaacgggcccctacgtccggtccttcccccgtggacccaccccgtcctacccaaacgacgccaacccgtccgtgggggccacgacggccggcccgtcggggctcgcccgtggtccgaaacgggaccttaccgttaccgacgttcgaagttcgacgtcggacgcgggcgtcggacg

SEQ ID NO: 378523 - DNA, 609 bp, Homo sapiens
  misc_feature: GZ8MTXP02F35A7.38.26.C04.1.454.CMB.2.raw
  modified_base (352)..(352): a, c, t, g, unknown or other
  modified_base (423)..(423): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtccctgcaaggcttctggaggcaccttcagcactatacttcagctgggtgcgacacggcccctggacaaggcttggagtggagtggggaggactcccgtcccgattcgtttaggaccaaaccncacctacgcacacagtccaggcagactcacgactaccgcgacactccacgacgacacagtacacagtgganagtgagtacgctaggagactacgtacgaaccgacgtacggtccgttagttacgtttcgtggtcggacggacgggaggggacgggggaccggagggggtccgttacgggggttacgggttaaacgggttaagggttcggttacgtttttacgggaagtttacggtacgggtacgggggtaaacccgg

SEQ ID NO: 378524 - DNA, 628 bp, Homo sapiens
  misc_feature: GZ8MTXP02HU1TS.38.26.C04.1.454.CMB.2.raw
  modified_base (206)..(206): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccncactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgatatcgtggggccaagggacaatggtcacccgtctcctcacgccctcccacccgaacggggccccacgtccggtaccctttccccccgtcggcccacccccgttcccttacccgaacgacgccacccgtccggtcgggggccaccgacggcccgggcccgtcggggccgtcggcccgttcgggttaccgaaacggggtaccttaccgttcccgtaacgtcggtaacgtccggaacgtcggacggccggggcgtcgggaccgg

SEQ ID NO: 378525 - DNA, 585 bp, Homo sapiens
  misc_feature: GZ8MTXP02IL6TW.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgtcttttgattagtcgtggggaccaaaggggacaagtcggtacaccgtctcctcacgccctccaccgacggcccacgtccgtccttcccctcggccctaccctcctaccaacgacgccacctcgtcggggacacgacggccggcccgtcgggcctcggccgtcggtacaaacggtaccttaccgttccgacgtcgaacgtcgacgtcggacggcggcgtcggacgg

SEQ ID NO: 378526 - DNA, 579 bp, Homo sapiens
  misc_feature: GZ8MTXP02GE95R.38.26.C04.1.454.CMB.2.raw
  modified_base (407)..(407): a, c, t, g, unknown or other
  modified_base (442)..(442): a, c, t, g, unknown or other
  modified_base (460)..(460): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgtcttttgatatcgtggggaccaagggacaagtgtcaccgtctcctcncgcctccaccgacggcccagtccggtcctccccgngccaccctctaccaagcncacctcgtcggggcacgacggccgccgtcgggcctcggccgtcggtcgaaacggtacctaccgttcccgacgttacgaacgttaccgaacgttcggacggccggggcgtcgggaaccgg

SEQ ID NO: 378527 - DNA, 556 bp, Homo sapiens
  misc_feature: GZ8MTXP02FS019.38.26.C04.1.454.CMB.2.raw
  modified_base (259)..(259): a, c, t, g, unknown or other
  modified_base (350)..(350): a, c, t, g, unknown or other
  modified_base (422)..(422): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttnagcacctatactttcagctgggtgcgacacggcccctggacaagggcttgagtggagtggggaggatcccgtccgattcttggacaaaccncacctacgcacacagtccaggcagactcacgattaccgcgacgaactccacgagacacagtacacagtgganagtgagtagcctagagatcgagaccgacgacggccgttagtacttcgtgtgacgaggagggacggggccgaggggtcgtacgggtaggttaacgttaaggtcgtacgtttaggattagtcggtaggggtaaccg

SEQ ID NO: 378528 - DNA, 678 bp, Homo sapiens
  misc_feature: GZ8MTXP02GPXWU.38.26.C04.1.454.CMB.2.raw
  modified_base (285)..(285): a, c, t, g, unknown or other
  modified_base (290)..(290): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctggtgaacggtcccctgcaaggtcttcgtggaggcaccttcagcactatacttcagcgtgggtncgacncggcccctggacaagggcttgaggtggagtggggaggactcccgtccgtattcgtttacggaccaaaccgacaacccgtacgacaacaacgtaacgttcccgaaggacacgactacgacgtaacgtacccggacggaaccaaactccgaacgacgaccaacgacgtacctaacgagtagggaagagtaggaacgttacggaccttaggagaacttcgaggaaccgaccggtacggtccgttagttacttcgtcgtaggacggtaagggacggggacgggggccggtaacgggggtccgttaccgggggttaaggtttaaacgggttaaggggttcgtttaccggtttttagggaacgtttacggtacggggttacggggaaaaccggg

SEQ ID NO: 378529 - DNA, 533 bp, Homo sapiens
  misc_feature: GZ8MTXP02ITJCP.38.26.C04.1.454.CMB.2.raw
  modified_base (437)..(437): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgttaggtgcttttgattatcgtggggccaaaggggacaagtgggtcaccgtctcctcagcctccacacggcccatcggtctccccngccaccctcctccaagacgccacctcgtggggcacacgcgccctgggctcgcctggcaaggctacttccacgtgaatcgactcgagcggctggacg

SEQ ID NO: 378530 - DNA, 645 bp, Homo sapiens
  misc_feature: GZ8MTXP02J48L2.38.26.C04.1.454.CMB.2.raw
  modified_base (234)..(234): a, c, t, g, unknown or other
  modified_base (380)..(380): a, c, t, g, unknown or other
  modified_base (499)..(499): a, c, t, g, unknown or other
  modified_base (579)..(579): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggaccctggaggttcctctttgtggtggcagcagctacaggtgtccagtcccaggtgcagttggtgcagtctggtcgtgaggtgagaagcctggtcctcggtgaagtccctgnaaggcttctggaggcaccttcagcacctatacttctagctgggtgcgacaggaccccgtcggtacaagggacgttgtagttggagtggtaacggtgttacgtccccgtcgttcccgtagttccgtaaaccgaccaaccccacaccncaacgtcaacgttaccgagtaccaggtccacgactcaccgggacttaccgacggaacccacacgaccgaactttacgtaccttacgtgtaaggtaaaggtggagtagttacgacggttnacccggagtctacgtacgaaccggtccggtaaccgggtctttcggttatttcgttcgggaggacacgggcgggactcggnggtcggtacggtaacggtacggttacggttacggttacggtttacgtttacggtttacggttacgg

SEQ ID NO: 378531 - DNA, 554 bp, Homo sapiens
  misc_feature: GZ8MTXP02HAQFO.38.26.C04.1.454.CMB.2.raw
  modified_base (424)..(424): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttggagtggatggggagggatcccgtcccgatctttggaccaaaccacaccctacgcaacacaagttccaggacagactcacgataccgcgacaatccacgagcacagtctacatgganatgagtagcctagagatcgtagacgacgacggtccgtagtattcgtgcgacgaggaggcgggggccagggggccgttacgggtggtaaacggttggtcgtacgttttaggagtacgtcggtaggggaccg

SEQ ID NO: 378532 - DNA, 564 bp, Homo sapiens
  misc_feature: GZ8MTXP02JB8WL.38.26.C04.1.454.CMB.2.raw
  modified_base (326)..(326): a, c, t, g, unknown or other
  modified_base (344)..(344): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagnggaggggcaggggctggnggtaacgttggtgtctttgatatcgtggggacaaggggacaagtggtccaccgtctcctcacgcctccaccgacggcccagtccggtccttcccccgtcggccacccctcctccaacgacgcaccgtcgtcgggggcacgacggccggcccgtgggcctcggccgtggtcgaacggtactacgttccacgtgaagtcgacgtcggaggcggcgtcggacg

SEQ ID NO: 378533 - DNA, 570 bp, Homo sapiens
  misc_feature: GZ8MTXP02I8CSC.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagaggggccaggggctcggtggtaacgtaggtgcttttgatatcgtggggccaagggacaagtggtcaccgtctcctcagcctccaccgaacggcccagtcggtccttcccccgtcggccaccctcctccgaacgacgccacctcgtcgggggcacgacgccggcccgtcgggctcggccgtggtaccgaaacggaccttacttaccgacgtgaacgtcgacgtcggacggccggcgtcggacgg

SEQ ID NO: 378534 - DNA, 561 bp, Homo sapiens
  misc_feature: GZ8MTXP02HD1B2.38.26.C04.1.454.CMB.2.raw
  modified_base (397)..(397): a, c, t, g, unknown or other
  modified_base (414)..(414): a, c, t, g, unknown or other
  modified_base (435)..(435): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagctggtgcgacaggcccctggacaagggctgagtggagtggggaggatccgtccgattcgtttggacaaaccacactacgccacacagtccagacagctcacgataccgcgacaactccacgancacagtcaacagtgganatagagtagcctagagatcgngacgacgacggccgtgtactttcgtgtcgcgaggacgggacgggggccgaggggtcgtcgggtacgggttaacggttagggtgttcgttttgacgttacgtcggtacggggaccgaagggtaaccg

SEQ ID NO: 378535 - DNA, 558 bp, Homo sapiens
  misc_feature: GZ8MTXP02HQQ9H.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggaggggccaggggctcggtggtaacgttaggtgcttttgatatcgtggggaccaaaggggacaaatcggcacccgtctcctcacgcctccaccgaacgggcccagtcgtccttccccctcggccaccctcctccaagacgccacctcgtcgggggcacgacgccgcccgtcgggctcgccctggtcaacggactacgtccacgtcgaactcgactcgacgcggcgcggacg

SEQ ID NO: 378536 - DNA, 626 bp, Homo sapiens
  misc_feature: GZ8MTXP02HOEBF.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgaggaggaggggccaggggctcgggtggtaacgttaggtgtcgtttttgattagtcgtgggggaccaaagggacagtcggtcacccgtctcctcacgcctcccgaaccgaacgggcccctagtcccggtcccttccccccgtcggccctacccccgtcctacccgaacgacgacctacccgtcgtcgggggccaccgacggcccggcccgtcgggccgtcggcccgtcggtaccaaacggtaccttaccgtacccgtacggttacgaacgttcgaacgtcggacggccgggcgtacggaaccgg

SEQ ID NO: 378537 - DNA, 651 bp, Homo sapiens
  misc_feature: GZ8MTXP02HZEGL.38.26.C04.1.454.CMB.2.raw
  modified_base (279)..(279): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaactccacgagcacagtctacatgganatgagtagcctgagatctgacgacacggccgtgtattctgtgcgagaggacggggcaggggctcggtacggtacgttaggtgtctttgattatcgtggggacctaagggactaagtcggtcaccgtctccgtcacgtccctaccaaccgaaacgggcccctacgttccggtaccccttcccccgtcggaccctacccccgtacccttacccgaacgtaccgacctaccccgtcggtccgggggacctacgacggccgggccccgtggggccttcggccgttacgggtacctaaacgggtaccctttaccgttaccgacggttacgaaccgtcggtaaaccgtgggaacggccggggtacgtacgggaaccgg

SEQ ID NO: 378538 - DNA, 553 bp, Homo sapiens
  misc_feature: GZ8MTXP02HT8LT.38.26.C04.1.454.CMB.2.raw
  modified_base (419)..(419): a, c, t, g, unknown or other
  modified_base (434)..(434): a, c, t, g, unknown or other
  modified_base (436)..(436): a, c, t, g, unknown or other
  modified_base (476)..(476): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctgggtcctcggtgaacggtcccctgcaaggtcttcgtggaggcaccttcagcacctatactttcagcgtgggtgcgacgacggcccctggacaagggcttgagtggagtgggaggtatccgtccgattcgttggaccaaacacacctacgcacactaagttcccagaccagactcgacgtactaccgacgacgaactccaacgancacagtcacatgganangagtacgctagagatcgagacgacgacggcgtgtattcgngtcgcgaggaggacgggccgaggggcgtcgggtaggtaacgttggtcgtcgtttagagttacgtcggtacgggtacg

SEQ ID NO: 378539 - DNA, 616 bp, Homo sapiens
  misc_feature: GZ8MTXP02JQ6NG.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagagaggggccaggggctcggtggtaacggttaggtgtctttgattatcgtggggacctaagggacaagtcggtcaccgtctcctcacgcctccaccgaacggcccacgtccggtcctcccccgtcggcccacccctccctacctaacgacgccacccgtccgtcgggggaccaccgacggcccggtcccgtcgggccgtcggacccgtcgggtaccgaaacgggtacctaccgttacccgaaccgttacgtaaccgtacgtacggacggccggggcgtacggggcaaacgggg

SEQ ID NO: 378540 - DNA, 643 bp, Homo sapiens
  misc_feature: GZ8MTXP02IKAFI.38.26.C04.1.454.CMB.2.raw
  modified_base (354)..(354): a, c, t, g, unknown or other
  modified_base (408)..(408): a, c, t, g, unknown or other
  modified_base (411)..(411): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagccgtgggtcctcggtgaacggtcccctgcgaaggcttcgtggaggcaccttcagcacctatacttcagctgggtgcgacacggcccctggacagggcttagagtggagtggggagggatcccgtccgatcttggcaaaccncacctacgcacacagttccagacagactcacgactcgacgacgaatccacgacncanagtctacatacggagatgagtacgctagaacgattacgtacgacggaaccacggggtaccgttaggttaattttccgtaggtttacggaccggaagggtaacggggaacggggggtaccggaaacggggggtccgttaccgggggtttagggtttaaaacggggtttaacggggttacggttacggttttttaggaaacgtttcggttaccggttacgggggtaaaaccggg

SEQ ID NO: 378541 - DNA, 559 bp, Homo sapiens
  misc_feature: GZ8MTXP02JTAGI.38.26.C04.1.454.CMB.2.raw
  modified_base (421)..(421): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacacggcccctggacaagggcttggagtggatggggagggatcccgtccgatcttggcaaaccacacctacgcacacagtccagcagactcacgataccgcgaacgactccacgagcacagtactacagtgganatgagtacgcctgagatcgtagaccgacacggccgtagttactttcgtggtgacggaggagggacgggggccgacgggggcgtacggggtggtaaacggttggtagtcgtttaggatacgttcggtcggggtaaccgg

SEQ ID NO: 378542 - DNA, 613 bp, Homo sapiens
  misc_feature: GZ8MTXP02JWKDD.38.26.C04.1.454.CMB.2.raw
  modified_base (285)..(285): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaacggtcccctgcaaggtcttcgtggaggcaccttcagcacctatactttcagctgggtncgacacggcccctggacaaggcttaggagtggagtgggaggactccgcccgtatcgtttggaccaaaccacacctacgcacacaacgttccgagacagactcacgacgttacccgacggaacgtaaactcccgaacgacgaccaacgtaacgtactaccagtaggagagtggaaagttcgaccgttaggagtactcgacgaaccgaaccgacggtccgttagttactttcgtgtacgcggaggagggcgggggccgacggggtccgtacggggtacggttaaacggttgggtcgttacgtttagagtacgtcggtacggggaaaccgg

SEQ ID NO: 378543 - DNA, 618 bp, Homo sapiens
  misc_feature: GZ8MTXP02I0HWT.38.26.C04.1.454.CMB.2.raw
  modified_base (291)..(291): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctggtgaacggtccctgcgaaggtcttcgtggacggcaccttcagcctacctatacttcagtcgtgggtcncgacgacggcccctaggacgaagggtcttggagtggagtgggaggctcccgtccgtattccgttagaccaaaccgactacccgtacgacaacacacgtaccagacagactacgacgtactacggacgaacaactccgacgacgacacacgtacacacgtagagtagtagtaacgtgaccgagacgacttcggacgaaccgtacgaccggtcgttacgttacgttgtggtaggcggtagggaggggaccggggcggtaacggggtcgtaacggggttcggtaaacggttggtacgttcggtttagaagttcggtacggacggtaacgg

SEQ ID NO: 378544 - DNA, 535 bp, Homo sapiens
  misc_feature: GZ8MTXP02HMBCS.38.26.C04.1.454.CMB.2.raw
  modified_base (343)..(343): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtgcgacaggcccctggacaagggcttgagtggatgggaggatccgtccgatcttggcaaaccncacctacgcacacaagttccaggcagactcacgattaccgcgacaatccacgagcacagtactacatggagatgagtagcctgagatcgtagacgacgacggccgtgtatttcgtgtgcgaggaggacggggcgaggggcgtcgggtaggtaacggttaaggtgtcgtttgattacgtcgtacgggtaacgg

SEQ ID NO: 378545 - DNA, 572 bp, Homo sapiens
  misc_feature: GZ8MTXP02HI8OB.38.26.C04.1.454.CMB.2.raw
  modified_base (432)..(432): a, c, t, g, unknown or other
  modified_base (485)..(485): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatacttcagctgggtgcgacacggcccctggacaagggcttgagtggagtggggaggatccctccgatcgtttggcaaaccacacctacgcacacaagttccaggacagactcacgacttaccgacggacgaactccaacgacacacagtacctacagtcggaaganagagtagaccgtggagatcgtagaccgacgtacggaccgtagttacgtttcgngttacgcgtagagggacggggccgaggggtcgtacgggtaggtaacggttaaggtcgtcgtttagagttacgtcggttgggaaccgg

SEQ ID NO: 378546 - DNA, 553 bp, Homo sapiens
  misc_feature: GZ8MTXP02JZ2I3.38.26.C04.1.454.CMB.2.raw
  modified_base (471)..(471): a, c, t, g, unknown or other
  modified_base (482)..(482): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacacggcccctggaccaagggcttgagtggagtggggaggatccgtccgatcgttggacaaaccacacctacgcacacagtccagcagactcacgataccgcgacgaactccacgagcacagtcacagtacggagatagagtacgcctagagatacgtagaccgacgaccggcgtagttactttcgngtgacggaggnggacgggggccgagggggctcggggtaggttaacggttggtcgtcgtttagagtacgtcggtggggaaccg

SEQ ID NO: 378547 - DNA, 690 bp, Homo sapiens
  misc_feature: GZ8MTXP02HGU0V.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacacggcccctggacaagggcttggagtggatggggagggactcccgtcccgattcgtttggaccaaaccgacaccctacgacacacaacgttccagaccagactcacgacttaccgacggtaacgaatcccgacgagacaacacgtactacagtcgggaagataggaagtagacccgttaggaggtactacgtacgaaaccgaccgtaccggggtacccgttaggtttacttttaccgtaggttccgggaaccggtaggggaggggaaccggggggtacccggaaaggggggtcccgttacgggggttacggggtttaaaacccggggtttaagggggttacggtttccggtttttaggaaccggtttaagttacccggggtttacgggggtaaaaccccgggg

SEQ ID NO: 378548 - DNA, 608 bp, Homo sapiens
  misc_feature: GZ8MTXP02H0KQ7.38.26.C04.1.454.CMB.2.raw
  modified_base (286)..(286): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatcccacgagcacagtctacatgagatgagtancctgagatctgacgacacggccgtgtatttctgtgcgaggaggaggggccgaggggctcgggtcggtaacgttaggtgtcgtttttgattatcggtacgggggaccaaaggggacctaaagtcggtctacccgtctcctcacgccctacccgaccgaacgggccccagtcccgggtcccttcccccgtcggtccctacccctcccgtaccaacgacgacctacccgtccgtcgggggcaccgacggcccggccgtcggcctcgcccgtggtacacggacttaccgtccgacgtgaacgtcgactcgacggcggcgtcggacg

SEQ ID NO: 378549 - DNA, 558 bp, Homo sapiens
  misc_feature: GZ8MTXP02HURB7.38.26.C04.1.454.CMB.2.raw
  modified_base (349)..(349): a, c, t, g, unknown or other
  modified_base (475)..(475): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatacttcagctgggtgcgacacggcccctaggacaagggcttggagtggagtggggaggatccgtccgatcgttggcaaacncacctacgcacacaagtccaggacagactcacgtatacccgacgaacgaactccgacgagacactagtctacatggagagtagagtagcctagagatacgtagacgacgacggctggtactttcgngcgcggaggaggacggggcgacggggcgtacgggtggtaacggttaaggtcgtcgttttagagttacgtcggtagggaaccgg

SEQ ID NO: 378550 - DNA, 569 bp, Homo sapiens
  misc_feature: GZ8MTXP02GM4QU.38.26.C04.1.454.CMB.2.raw
  modified_base (375)..(375): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcggttggtgcagtctggggctgaggtgaagaagcctgggtcctcggtgaaggtcccctgcaaggcttctggaggcaccttcagcacctatactttcagctgggtgcgacaggccccctggacaagggcttggagtggagtgggaggatccgtcccgatctttggcaaaccacactaccgcacacaagttccaggacngactcacgattaccgcgacaatccacgagcacagtctacatgagatagagtagcctagagatctaggacgacgacggccgtgtactttcgtgcgcggaaggagggagggggccgagggggcgttaccggggtaggttaacggttagggtcgttcgttttaggagttacgtcggttacgggggaccgtaaagggg

SEQ ID NO: 378551 - DNA, 576 bp, Homo sapiens
  misc_feature: GZ8MTXP02FO1LQ.38.26.C04.1.454.CMB.2.raw
  modified_base (353)..(353): a, c, t, g, unknown or other
  modified_base (430)..(430): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagcgtgggtgcgacacggcccctggaccaagggcttggagtggagtgggagggactccgtccgatcgtttgacaaaccncacctacgcacacagtccagcagactcacgactaccgcggacgaactccaacgacgacacagtactacgagtagganagtgagtacgcctagagtattcgacgaccgacgacggccgtgttacttcgtggtgacggaggacgggacgggggacgacgggggtcgtacggggtaggtaaacggtttggtcggttcgttttgagttacgtccggtcgggaaccgg

SEQ ID NO: 378552 - DNA, 630 bp, Homo sapiens
  misc_feature: GZ8MTXP02GAI6H.38.26.C04.1.454.CMB.2.raw
  modified_base (285)..(285): a, c, t, g, unknown or other
  modified_base (354)..(354): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtncgacacggcccctggacaaggcttggagtggagtggggaggactcccgtcccgattcgttgacaaaccncacctacgcacactaacgtccaaggcagactacgaccgtacttaccggcggaacgaaactcccgaacgaacgcaacgagtacacagtacggagatcgaagtacgcctagagtactacgtagaaccgacgacggtccgtagttacgtttccgtgtaggacgtagggacggggacgggggaccgaacgggggtccgttacgggggttagggttaaaccggtttaagggttacgttcgtttttaggacgtttaacggttccgggtacggggtaaaccgg

SEQ ID NO: 378553 - DNA, 579 bp, Homo sapiens
  misc_feature: GZ8MTXP02JHHLY.38.26.C04.1.454.CMB.2.raw
  modified_base (278)..(278): a, c, t, g, unknown or other
  modified_base (402)..(402): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacacggcgtgtatttctgtgcgagaggaggggcaggggcgtcggtaggttacgttaggtgtcgttttgattatcggtggggccaaagggacaagtcggtacnccgtctcctcacgcctccaccgaacggcccacgtccggtccctccccgtcggtcccaccctcctacccgaacgacgccacccgtcggtcgggggaccacgacgccgacccgtcgggctcgcctggacgaacggtacctacctaccgactcgaactcgacgtggacgcggcgtggacg

SEQ ID NO: 378554 - DNA, 667 bp, Homo sapiens
  misc_feature: GZ8MTXP02IT0T2.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagcctgggtcctcggtgaacggtcccctgcaaggcttcgtggaggcaccttcagcacctatacttcagctgggtgcgacgacggcccctggacgaaggcttggagtggagtggggaggactcccgtcccgtattccgtttacggacctaaacccactaccctaccgaccaaccaacgtaacgttacccgaaggaccaagacctacgaccgtaacgttacccggacggaaccgaaactcccgaacgacacactagtacctaacagtaggaagagtagaagtacgccgtaggtaagtattacgacgaccgaccgtaacggtccgttagttacttccgtgtacggacggaagggaggggacgggggaccggtaacggggtccggttacggggttacggttaaacgggttggttggttacgttttacggagtttacggtacgggttacggggaaaccggg

SEQ ID NO: 378555 - DNA, 570 bp, Homo sapiens
  misc_feature: GZ8MTXP02JZ2P7.38.26.C04.1.454.CMB.2.raw
  modified_base (472)..(472): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttctggaggcaccttcagcacctatacttcagctgggtgcgacaggcccctggacaaggcttgagtggagtggggaggactcccgtcccgatcgtttggacaaaccacaccctacgcacacagtccagcagactcacgactaccgacgacgaactccgacgacgacacgagtcacagtggagatgagtagccgtgagatctagacgacgacggtccgttgtactttcgnggtcgcggaggagggacgggggaccgtagggggccgtcggggtacgggttaacggttgggtcgttcgtttaggattacggtcggttacggggaaccgg

SEQ ID NO: 378556 - DNA, 836 bp, Homo sapiens
  misc_feature: GZ8MTXP02IENWL.38.26.C04.1.454.CMB.2.raw
  modified_base (282)..(282): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatcttttggcaaaccacactacgcacacaagttccaggacagactcacgacttaccgcggacgaactccaacgagcacagtctacatgganatgaagtagcctgagatcgtagacgacgacggccgtagtatttctgtggcgaggaggagggggccaggggctcgggtggtaaacgttgggtgtctttttagagttagtcgggtagggggaccgtaaagggggtacctaaaggttcgggtaccctaaccccgtcccttcccgtacccgtaaccgtcccccgttaccccgaaaccccggaaaccgggggtaccccccgtaacggtttcccccggggttaccccctttacccccccggttcccgggaccccccgttaacccccgtttcccccttaaacccccggtaaaaccgggaacccggtaccccggtaacccccggtttcccgggtaccggggggtaccctaacccgggaaccggggcccccgggtcccccggggtcgggggtacccggttccgggcccggttacgggggttacccaaaaccgggggtacccctttaacccgttcccgtaaaccggttcggtaaccggttaccggtaacggttcggggtacggggtacccggggtccggtacggggaacccggg

SEQ ID NO: 378557 - DNA, 600 bp, Homo sapiens
  misc_feature: GZ8MTXP02GVFXJ.38.26.C04.1.454.CMB.2.raw
  modified_base (323)..(323): a, c, t, g, unknown or other
  modified_base (350)..(350): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagaagcctgggtcctcggtgaaggtcccctgcaaggcttctggaggcaccttcagcacctatacttcagctgggtgcgacacggcccctggacgaaggcttggagtggagtgggaggntccgtccgattcgttggacctaaaccncacctacgacaacacaacgttccaaggacagactcgacgactaccgacgaacgaactaccaacgacgaccaacacgtacaccgagtaggaagatagaagttacgaccgtgaagatctagacgacgaaccggccgtagttactttcgtggtcgacggaggagggacgggggaccgtacgggggccgtacggggtaggttaaccggtttaagggtgttaccgtttagacgttacgtcggtacggggtaaccg

SEQ ID NO: 378558 - DNA, 593 bp, Homo sapiens
  misc_feature: GZ8MTXP02FZ9AI.38.26.C04.1.454.CMB.2.raw
  modified_base (343)..(343): a, c, t, g, unknown or other
  modified_base (412)..(412): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcaccctatactttcagctgggtgcgacaggcccctggacaagggcttgagtggatggggaggatcctccgatcttgcaaacncactacgcacacagtccagcagactcacgattaccgcgacgaatccacgagcaacagtactacatgganagtgagtagcctagagatactagaaccgacacgacggtaccgttgttaaactttcgtacggttacggccggtaaggaacgggacggggggaccgtaacggggggtccgtcgggggttaggggttaaaccggtttaggggttacggtaccggttttagtaagttacgtacggttaacggggg

SEQ ID NO: 378559 - DNA, 559 bp, Homo sapiens
  misc_feature: GZ8MTXP02HOND8.38.26.C04.1.454.CMB.2.raw
  modified_base (282)..(282): a, c, t, g, unknown or other
  modified_base (432)..(432): a, c, t, g, unknown or other
  modified_base (471)..(471): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagaagcctgggtcctcggtgaaggtcccctgcaaggcttctggaggcaccttcagcacctatactttcagctgggtncgacgacggcccctggacaagggtcttgagtggagtggggagggatcccgtccgattcttaggaccaaaccacacctacgcacacagttccagacagactcacgtactaccgacgacgaatcccgagagacacagtactacagtggagangagtagctagagatcgagacgacacggccgtgtacttcngtgcgaggaggacggggccgaggggcgtacggggttaggtaacggttaaggtcgtacgttttgacgttacgtcggttacgggaaccgg

SEQ ID NO: 378560 - DNA, 545 bp, Homo sapiens
  misc_feature: GZ8MTXP02IECFT.38.26.C04.1.454.CMB.2.raw
  modified_base (248)..(248): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctcttttgtggtggcagcagctacaggtgtccagtcccaggtgcagttggtgcagtctggggctgaggtgaagaagcctgggtcctcggtgaaggtcccctgcaaggcttcnggaggcaccttcagcacctatactttcagctgggtgcgacacggcccctggacaagggcttgagtggatgggagggactcctcccggatctttggcaaaccacacctacgcacacaagttccaggacagactcacgattaccgcgaacgaaatccaacgagcaacagtactacatggagatgagtagcctagagatctgacgacacggccgtgtattctgtgcgagaggacggggccgaggggctcgggtaggtaacggttaaggtgtcgttttaggaattgtcgtacggggaccgg

SEQ ID NO: 378561 - DNA, 594 bp, Homo sapiens
  misc_feature: GZ8MTXP02H7DDV.38.26.C04.1.454.CMB.2.raw
  modified_base (282)..(282): a, c, t, g, unknown or other
  modified_base (498)..(498): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatacttcagctgggtncgacacggcccctggacaagggcttgagtggagtgggagggactccgtcccgattcgtttaggacctaaaccacaccctacgaccaacacgaagttccaaggacagactacgacgtactacccggacgaacaactcccacgacgcaacagttactacagtgagatagagtagacctgaacgtatcagaacgaacgacacgccgttatacgtttcgngtagacggtaggacggaacgggggccgacgggggtctcggggttagggttaaaccggttgggtacgttcgttttaggacttaggttcgaacggggg

SEQ ID NO: 378562 - DNA, 682 bp, Homo sapiens
  misc_feature: GZ8MTXP02G2RNJ.38.26.C04.1.454.CMB.2.raw
  modified_base (324)..(324): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctagagatctagacgacgacggtccgttagtatttcnggtgcgaggaggacgggggccaggggctcggtaggtaacgttaggtgtcttttgattagtcggtggggaccgaaagggacaaagttcggtctacccggtctcctcgacgccctaccgaaccgaacgggcccacgttcccggttcccttcccccgtcgggaccctacccccttccgtacccgaaacgaccgcccgtaacccgtccgggtacgggggaccaacgaccgggcccgggtccccgtcggggccgtcggacccgttaggggtaccgtaaacggggtaacccttaccgtttacccgaacggttacgtaaccgttaccggacgttacgggacggcccgggtacgtacgggaaccgg

SEQ ID NO: 378563 - DNA, 622 bp, Homo sapiens
  misc_feature: GZ8MTXP02I6CB0.38.26.C04.1.454.CMB.2.raw
  modified_base (278)..(278): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacacggccgtgtatttctgtgcgagaggagggggccaggggcgtcggtggtaacgttaggtgtcttttgattatcgtggggaccaagggacaagtcggacaccgtctcctcacgcctccacgacggcccagtccggtcctccccgtcggccacccctcctccgaagtacgcctacccgtcgtcgggggcacgacggccggtccgtcggggaccttcggccgttacgggtaccgtaaaacggtacccgttacgttacccgtaacgttacggtaacgtaccggtaaccgtacgggaacggtccggggtacggtcgggaacccgg

SEQ ID NO: 378564 - DNA, 725 bp, Homo sapiens
  misc_feature: GZ8MTXP02JJEGY.38.26.C04.1.454.CMB.2.raw
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctggaggtgaagaagccgtgggtccgtggtgaacggtcccctgcaaggtcttcgtggaggcctaccttcagccacctatacttcagcgtgggtgcgacgacggccccgtggacgaggtcttggaggtggtaggtggggagggtactccccgtacccggtattcgtttacggaccctaaaccgacaacccgtaccgaccgaacaacgtaacgttccgaacggaccacggtaacctaccgaacgtaaccgttacccggaccgggtaaacctaaactcccgaacgtacggacaacgacgtactacgagtacggagtagtgaagtacgtaccgtagaagtacgtacgtacgaccgaaccgtacgggtccgttagtttacgtttacgtgtacggtaccggtaagggacggggaccgggggacccggtaagggggtcccggttaacgggggttaacggggtttaaccggtttaagggttacggtttcggttttaggacgtttacggttaccggggtacggggttaaaacccgggg

SEQ ID NO: 378565 - DNA, 599 bp, Homo sapiens
  misc_feature: GZ8MTXP02GB97X.38.26.C04.1.454.CMB.2.raw
  modified_base (328)..(328): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggnggggccaggggctcgggtggtaacgttaggtgtcttttgatagtcggtggggacctaaaggggaccaagtcggtcacccgtctcctcacgccctaccaaccgaacggccctacgtccggtcccttcccccgtcggccctacccctccctacccgaacgacgacccaccgttccgcgggggacacgacggccggcccgtgggctcggaccgtggtacaaacggtctaaccgttccacgtagaacgtcgacgtacggcgcgggcgtaggacgg

SEQ ID NO: 378566 - DNA, 522 bp, Homo sapiens
  misc_feature: GZ8MTXP02IRGWT.38.26.C04.1.454.CMB.2.raw
  modified_base (364)..(364): a, c, t, g, unknown or other
  modified_base (408)..(408): a, c, t, g, unknown or other
  modified_base (428)..(428): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggcaccttcagcacctatacttcagctgggtgcgacacggcccctggacaagggcttgagtggatgggaggatcctccgatcttgcaaacgtcactacgcacacaagtccagcanactcacgataccgcgacaactccagacgcacagtctacatgganatagagtagcctagagatcngacgacgacgcgtgtatttcgagtcgacgaggaggacgggggtccaggggctcggtaggtacgtaaggtgtacgtttgatacgtcgtagggacg

SEQ ID NO: 378567 - DNA, 675 bp, Homo sapiens
  misc_feature: GZ8MTXP02H5PAR.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaacgtcccctgcaaggcttcgtggaggcaccttcagcacctatacttcagctgggtgcgacacggcccctggacgaagggcttgaggtggagtggggaggactccctccgtattcgttacggacaaaaccacacccgtaccgaccaccaactaacgttacccaagggaccaacgaactaccaaccgtaacttacccgggacggtaacgaacctaccgacgaacgcaacacgtactaacgagtacggaagtagtagtagtacgtaccgtaggaacgtatacgtacggaaccgaaacgaacgacggtaccgttacgttaacgttttccgaggttcgggaaccggtaggggaaacgggaccggggggccgaacgggggtccgtacggggttacgggttaaccggtttagggtacggttcgtttaggtacgttaacggtttcggtaaacggggg

SEQ ID NO: 378568 - DNA, 555 bp, Homo sapiens
  misc_feature: GZ8MTXP02FP075.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatggggactgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagaggaggggccaggggctcggtggtaacgttaggtgtcttttgatatcgtggggccaaagggacaagtggtcaccgtctctcacgcctccacgacggcccagtccgtccttcccctggccaccctcctccaagacgccaccgtcgtcggggacacgacgccgcccgtcgggctcgccgtggtacgaacggactactccgacgtgaacgtcgacgtggacgcgggcgtgacg

SEQ ID NO: 378569 - DNA, 570 bp, Homo sapiens
  misc_feature: GZ8MTXP02IXM58.38.26.C04.1.454.CMB.2.raw
  modified_base (446)..(446): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctggtgcgagaggaggggcaggggctcggtggtaacgttaggtgcttttgattatcgtggggacaaggggacaagtggtcaccgtctcctcacgcctaccacgaacggcccagtccggtccttcccccgngccaccctccaccctaagcgaccaccgtcgtcggggcacgacgccggccgtgggcctcggccgtggtaccgaacggtactaccgttccgacgtgaacgtcgacgtcgacggcggcgtaggaccg

SEQ ID NO: 378570 - DNA, 561 bp, Homo sapiens
  misc_feature: GZ8MTXP02JRHYV.38.26.C04.1.454.CMB.2.raw
  modified_base (283)..(283): a, c, t, g, unknown or other
  modified_base (346)..(346): a, c, t, g, unknown or other
  modified_base (416)..(416): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtncgacaggcccctggacaaggcttgagtggatgggaggatccgtcccgatcgtttggcaaaccncacctacgcacacagttccaggccagactcacgataccgcgacaatcccagagcacagtctacatggaanatgagtacgctgagtatcgtagacgacgacggtcgtagttacttcgtgtcgacgtaggacgggacgggggaccgtacgggggcgtcggggtacggttaacggttaacggtcgttacgttttagagttacgtcggtacgggtaccg

SEQ ID NO: 378571 - DNA, 539 bp, Homo sapiens
  misc_feature: GZ8MTXP02I05P4.38.26.C04.1.454.CMB.2.raw
  modified_base (341)..(341): a, c, t, g, unknown or other
  modified_base (458)..(458): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggaggcaccttcagcacctatactttcagctgggtgcgacaggcccctggacaagggcttgagtggatgggaggatccgtccgatcttgcaaacncactacgcacacagttccagcagactcacgattaccgcggacaatccacgagacacagtacacatcggagatgagtaagcctgagatcgtagacgacgacggccgtagtactttcgngttagcgagacggacgggggccaggggctcgggtggttaacggttaaggtgtacgttttgacttagtcgtacggggaaccg

SEQ ID NO: 378572 - DNA, 595 bp, Homo sapiens
  misc_feature: GZ8MTXP02JXSIS.38.26.C04.1.454.CMB.2.raw
  modified_base (417)..(417): a, c, t, g, unknown or other
  modified_base (581)..(581): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttctggaggcaccttcagcacctatacttcagctgggtgcgacacggcccctaggacagggcttggagtggagtggggaggactccgtccgatcgttcgacaaaccacacctacgcacacacgtccaggcagactcacgataccgacgacgactaccacgacgcacagtcacncgtaggagagtagagtagcctagagtatcgtagacgacgacggtcgtagttacgtttcgtgtcgaccggtaggacgggacgggggaccgaacgggggtctacgggggttacggttaaaccgggtttgggtcggtttacggtttacggagttacggtttaccggngggggtaaacccgg

SEQ ID NO: 378573 - DNA, 561 bp, Homo sapiens
  misc_feature: GZ8MTXP02FG759.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgcttttgatatcgtgggggccaaagggacaatggtcaccgtctcctcagcctccaccaggcccatcgtctccccctgccaccctcctccaagcgcacctccgtgggggccacgacgccggccctgggcctcgccctgggttcaaacgggacctaccgtttcccacggtcgaacgtcgaactcggacggcggggccgcggacg

SEQ ID NO: 378574 - DNA, 709 bp, Homo sapiens
  misc_feature: GZ8MTXP02ID6ZQ.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagaagcctgggtcctcggtgaacggtcccctgcaaggcttcgtggagcaccttcagcacctatacttcagctgggtgcgacgacggcccctggacaagggcttggagtggagtggggacggtctcccgtccgtagttcgttacgaccaaaccgacacccgtacgacacgaactacgttaccgaagacacgaactacgaacgtacctaccggacgaacgtaacacccgagacgacacgaagttaccaacgagtaggaagtacgtaggtaagtacgaccgtaaggacgtacttcggaacgaacccggtaacgtaccggggtaccgtttaggtttaaccgtttccggtaggttacgggtaaccggaaggggacgggggtaaccgggggaccgggtacgggggtaccggttacgggggttaacgggttaaaaccgggtttggggttaccggtttaacggttttaggaacgtttacgggtaccggggttaacggggaaaacccgggg

SEQ ID NO: 378575 - DNA, 716 bp, Homo sapiens
  misc_feature: GZ8MTXP02HCDFX.38.26.C04.1.454.CMB.2.raw
  modified_base (289)..(289): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagccgtgggtcctcggtgaacggtcccctgcaaggcttcgtggaggcaccttcagcacctatactttcagcgtgggtncgacacggcccctggacaggcttggagtggagtggggaggactcccgtccgattcgttacggaccaaaccacaccctacgaccaacacaacgttccaaggacacgacctacgacgtacgtacccgacggtaaaccaactcccgaaacgacgaccacgtacgtactaacagtacgggaataagtggaaacgtacggaccgttaggaacgtacttccgtaacggaacccgaaacctaacggtaccggttacccgtttaagggtttaaccttttccggtaacggttgggaaccggtaaggggtaacggggaccggggggtacccggtaaacggggggtccgtttacgggggttaaacgggtttaaaccggggttggtttaccgggtttacgtttttaggaacggtttacggttaccgggttaaccggggg

SEQ ID NO: 378576 - DNA, 606 bp, Homo sapiens
  misc_feature: GZ8MTXP02IVE76.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggagggggccaggggctcgggtaggtaacggttaggtgtcgtttttgattagtcgtgggggaccaaaggggacaagtggtcaaccgtcctcctcacgccctccacccgaacggcccagtccgtcccttcccccgtcggccctacccctccctaccaagacgccaccgtcgtcgggggcacgacggccggcccgtcgggcctcggccgtcggtaccgaaacggtaccttaccgttacccgacggtcgaacgtcgacgtcggacggccgggcgtcgggaacg

SEQ ID NO: 378577 - DNA, 651 bp, Homo sapiens
  misc_feature: GZ8MTXP02IZ7RB.38.26.C04.1.454.CMB.2.raw
  modified_base (317)..(317): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggcgtgtatttcngtgcgagaggacggggcaggggctcggtggtacgttagtgtctttgatatcgtgggccaagggacaagtcggtacaccgtctcctcacgccctccgacccgaaacgggcccctaagttcccgggttcccttaccccccgtcgggtcccctaacccccgttcccgtaccccaaagtaccgacccgtacccgtccgggtacgggggaccaaccggacgggcccggtccccggtcggggccgtcggcccgttagggtaccgtaaacgggtacccttaccgtttacccgacggtttacgaaccgtcgtaacgttcggacggtccggcgtacggaccgg

SEQ ID NO: 378578 - DNA, 577 bp, Homo sapiens
  misc_feature: GZ8MTXP02G22DK.38.26.C04.1.454.CMB.2.raw
  modified_base (421)..(421): a, c, t, g, unknown or other
  modified_base (437)..(437): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagctgggtcctcggtgaaggtcccctgcaaggcttcgtggaggcaccttcagcacctatactttcagctgggtgcgacacggcccctggacaagggcctggagtggatgggagggatcccgtccgatcgttggcaaacacacctacgcacactaagttccaggcagactcacgataccgcgacgaatccacgagcacatacgtacagtaganatgagtcaccgtgagnttcgagacgacacggtcctaggtactttcgcgtacgacggaggacgggacggggaccggtacggggtacgttacggggttacggttaacggttaaggttacgttacggtttagacgttacggttacgggacgggtaacgg

SEQ ID NO: 378579 - DNA, 597 bp, Homo sapiens
  misc_feature: GZ8MTXP02IH63G.38.26.C04.1.454.CMB.2.raw
  modified_base (317)..(317): a, c, t, g, unknown or other
  modified_base (344)..(344): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttctggaggcaccttcagcacctatactttcagctgggtgcgacacggcccctggacaagggcttgagtggagngggagggatcctccgatcttgcaaacncacctacgcacacaagttccagtacagactacacgacttaccgacggtaacaactccacgacgcacagtctaccagtaggaagagtgaagtacgaccgtagagtatcgtagaccgacgacggccgttagttactttcgtagtgacgtaggagggacgggggaccggacggggtcgttacggggttaggttaaccgggtttaaggttacggttacgttttaggaacgtttacggtcggttacggggtaaaccgg

SEQ ID NO: 378580 - DNA, 580 bp, Homo sapiens
  misc_feature: GZ8MTXP02H5TV8.38.26.C04.1.454.CMB.2.raw
  modified_base (243)..(243): a, c, t, g, unknown or other
  modified_base (412)..(412): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtccctgcaggctcnggagcacttcagcacctatactttcagctgggtgcgacacggcccctggacaagggcttgagtggagtgggaggatccctccgatcttggacaaaccacactacgcacacagtccagcagactcacgataccgacgacaactccacgagcacagtactacagtggaagntagagtagccgtgagatctaggaaccgacgaccgggtccgtagttacgtttctaggtcggacgaggaagggacgggggaccgacgggggtcgttaccggggttagggttaacgggtttaaggtcggttaccgtttttaggaagtttacggttcggtacggggaaccgg

SEQ ID NO: 378581 - DNA, 556 bp, Homo sapiens
  misc_feature: GZ8MTXP02JMR55.38.26.C04.1.454.CMB.2.raw
  modified_base (282)..(282): a, c, t, g, unknown or other
  modified_base (350)..(350): a, c, t, g, unknown or other
  modified_base (402)..(402): a, c, t, g, unknown or other
  modified_base (422)..(422): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtncgacaggcccctggacaagggcttgagtggagtgggagggatccgtccgatcgtttggacctaaaccncacctacgcacacagttccaggcagactcacgataccgcgacgaatccacgngacacagtctacatacgganagtgagtacgcctagagatcgtagacgacgacggccgtggttatttcgtgtgtcggaggagggacgggggccgagggggtcgtcgggtaggttaacggttggtgttcgtttggattacgtcggtaggggtaccg

SEQ ID NO: 378582 - DNA, 553 bp, Homo sapiens
  misc_feature: GZ8MTXP02IO3XQ.38.26.C04.1.454.CMB.2.raw
  modified_base (338)..(338): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttctggaggcaccttcagcacctatacttcagctgggtgcgacaggcccctggacaaggcttgagtggagtggaggatcctccgatcttgcaaaccncacctacgcacacagttccaggacagactcacgtataccgacgacgaatccagacgcacacgtactacagtaggagatagagtagtaccgtagagatacgacgacgacgacgggtccgtggtttacttgtacgtgacgacggtaggacggggaccgaggggtcgtacgggtaggtacgttaaggtgttacgtttcgatcgtcgttagggaaccgg

SEQ ID NO: 378583 - DNA, 520 bp, Homo sapiens
  misc_feature: GZ8MTXP02FTGS3.38.26.C04.1.454.CMB.2.raw
  modified_base (432)..(432): a, c, t, g, unknown or other
  modified_base (443)..(444): a, c, t, g, unknown or other
  modified_base (450)..(450): a, c, t, g, unknown or other
  modified_base (457)..(457): a, c, t, g, unknown or other
  modified_base (463)..(463): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggccaggggctcggtggtaacgttaggtgcttttgattatcgtggggccaaaggggacaatggtcaccgtctcctcagcctcaccaggccatcgtctcccngcacctctcanncactcngggcacngcgccngggctcgctggtcaaggactacttccacgtcgaatcgactcggacgcggctcggacg

SEQ ID NO: 378584 - DNA, 604 bp, Homo sapiens
  misc_feature: GZ8MTXP02IYAVN.38.26.C04.1.454.CMB.2.raw
  modified_base (321)..(321): a, c, t, g, unknown or other
  modified_base (468)..(468): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtacgcctagagatctagacgacgacggcgtgtattcgngtgacgagaggaggggaccgaggggcgtacggtaggttaaacgttaggtgtatttagatatcggtagggaccaaagggtacaagtcggacctacgtctcctacacgccctaccaccgaaacggccctacgtccggtcccttccccgngtacccacccctccgaaccaagacaccaccgtcggacggggccacgacgccggccgtcggctcggccgtggtaaccaaggtacctaccgttacccgacggtaacgtaacgcgtacgacggacggcggcgacggacg

SEQ ID NO: 378585 - DNA, 714 bp, Homo sapiens
  misc_feature: GZ8MTXP02GZR9Y.38.26.C04.1.454.CMB.2.raw
  modified_base (281)..(281): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtcccctgcaaggcttctggaggcaccttcagcacctatactttcagctgggtncgacacggcccctggacaagggcttggagtggagtggggagggtactcccgtccggattcgtttacgggacctaaaaccgacaaccccgtacgaccaacgaactaaacggtttcccaagggaccaacggacctccgaacgtacgttaaccggacgggaaccgaaactcccgaaacgacgaccaacgaacgttactaaccgagttagggaagagttaggaaagttacggacccttagggaacgtaacgttcgtaacggaacccgaaccggaaccggggtcccgttaggtttaccttttcgcggccggtacggaaggggacggggaacggggggcccgaagggggtccgtacgggggttacggttaaacggggtttgggttacggtttacgttttaggaacgtttacggttaccgggttacgggggtaaacccgg

SEQ ID NO: 378586 - DNA, 596 bp, Homo sapiens
  misc_feature: GZ8MTXP02H950Z.38.26.C04.1.454.CMB.2.raw
  modified_base (410)..(410): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagaggaggggccaggggctcgggtaggtaacgttaggtgtctttttgattagtcgtggggacaagggacaagtggtcacccgtctccncacgccctccacccgaaacggcccacgtccggtcccttcccccgtcggccctacccctccctaccgaaacgcgccgaccctcgtcggggccaacgcggccggcccgtcgggctcgccgtcggtacaacggtacctaaccgtccgtaacgtacgtccgacgtcgacggccggtcgtcggacgaacgg

SEQ ID NO: 378587 - DNA, 569 bp, Homo sapiens
  misc_feature: GZ8MTXP02JFZKK.38.26.C04.1.454.CMB.2.raw
  modified_base (282)..(282): a, c, t, g, unknown or other
  modified_base (420)..(420): a, c, t, g, unknown or other
  modified_base (470)..(470): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctgggtgaaggtcccctgcaaggcttctggaggcaccttcagcacctatacttcagctgggtcncgacacggcccctggaccaagggcttggagtggagtgggaggatccctcccgattcgtttggacaaaccacacctacgcacacagttccagcagactcacgataccgcgacgactccgagagcacagtactacatganatagagtacgccgtagagacgttacgagaaccgacgacgggccgtttatntttccgtgtgtcggaggagggacgggggccgagggggcgttacggggtggttaacggttggtagttacgttttacggagtacgttcggaggggtaccgg

SEQ ID NO: 378588 - DNA, 646 bp, Homo sapiens
  misc_feature: GZ8MTXP02HKDX6.38.26.C04.1.454.CMB.2.raw
  modified_base (357)..(357): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctggaggtgaagaagcctgggtcctcggtgaacggtcccctgcaaggcttcgtgggaggcaccttcagcactatactttcagcgtgggtgcgacacggcccctggacaaggcttggaggtggagtggggaggactcccgtccgattcgttcggacaaaccncaccctacgacacactaacgtccaaggcacgactacgaccgtacttaccggacggaaccgaaactcccgaaacggtacgaccaacgtacgtacctaacgaagtacgggaagagttggaacgtacgtccgtaggtagactgtaccgaacgaccgacgggtcgtagttacgtttccgtgtcgggtacgacggggtaggacgggggccggtaacggggtccgtacggggttaacgggttaacggttgggttccgttacgttttacggagtttacggtcggtacggggtaacg

SEQ ID NO: 378589 - DNA, 559 bp, Homo sapiens
  misc_feature: GZ8MTXP02JPUBW.38.26.C04.1.454.CMB.2.raw
  modified_base (349)..(349): a, c, t, g, unknown or other
  modified_base (424)..(424): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacaggcccctggacaagggcttgagtggagtgggagggatccctccggatcgtttggacaaaccncaccctacgcacacaagttccaggacagactcacgattaccgcgacaatccaacgagcacagtctacatacgganatgagtacgcctgacgatcgtagacgacgaccggccgtgtactttcagtggacgagagggacgggggccgacgggggtctcggggtaggtaacggttaagggtcgtacgttttggattacgtcgttggggaaccg

SEQ ID NO: 378590 - DNA, 619 bp, Homo sapiens
  misc_feature: GZ8MTXP02FWS6V.38.26.C04.1.454.CMB.2.raw
  modified_base (206)..(206): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccncactacgcacacaagttccaggacagactcacgattaccgcggacgaatccacgagcacagtctacatggagatgagtagcctgagatctgacgacacggccgtgtatttctgtgcgaggaggaggggccaggggctcgggtgtacgttggtgtctttgattatcgtgggggaccaaaggggacaagttggtcacccgtctcctcacgccctaccaccgaacgggcccctagtccggtcccttcccccgtggcccctacccgtcctaccaacgacgccaccgttcgcggggacacgacgccgggcccgtcggggctacgggccgtagggtaccgaaaggtaccctttaccgttacccgacggttacgaacgttaccggaaccgttcgggacggtccggggacgtcggaaccgg

SEQ ID NO: 378591 - DNA, 632 bp, Homo sapiens
  misc_feature: GZ8MTXP02FPKAD.38.26.C04.1.454.CMB.2.raw
  modified_base (294)..(294): a, c, t, g, unknown or other
  modified_base (297)..(297): a, c, t, g, unknown or other
  modified_base (319)..(319): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcggacgaactccacgagcacagtctacatggagatcgagtagcctgagntcngacgacacggccgtgtatttcngtgcgaggaggacgggggccagggggctcggggtaggttaacggttggtagtcttttagacttagtcgtagggggaccaaaggggacaagttcggtactacccgtcgtcctcgacgtccctaccgaaccgaacggcccctacgtcccgggtacccttcccccgtcggccctaccccctaccctaccgaaacgaccgacctacccgtccggtcgggggaccacgacggcccggcccgtcggggcctcggcgtcggtacgaacggtactaccgtccgacgttcgaacgtcgacgtcggacggcggcgtacggacg

SEQ ID NO: 378592 - DNA, 720 bp, Homo sapiens
  misc_feature: GZ8MTXP02GBT0T.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggtcttctgggaggcaccttcagccacctatactttcagctgggtgcgacacggcccctggacaagggcttggagtggagtggggaggactcccgtcccgattctttaggacaaacctacacctacgcaacacaaacgttccgaaggacacgacctacaaccgtacttaaccggacggaacgaaactcccgaacgacgacaacgacgtactaacagtaggaagtaagtgaaacggttacgacccgttaggaaggtacttaccgtaggaaacccggaaccggtacccggggtacccggtttagtttaacgtttcccgttagggttcggaaccgggtaaggacgggggtaacggggggacccggtaacggggggtacccggttacgggggttaacgggttaaaaccggggtttaagggttcggttaccgttttttacggaagtttaacgggtcccggggtttaacgggggaaaaccccggg

SEQ ID NO: 378593 - DNA, 728 bp, Homo sapiens
  misc_feature: GZ8MTXP02H6NXU.38.26.C04.1.454.CMB.2.raw
  modified_base (244)..(244): a, c, t, g, unknown or other
  modified_base (279)..(279): a, c, t, g, unknown or other
  modified_base (442)..(442): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagccgtggtcctggtgaagtcccctgcaggcttcgnggagcaccttcagcacctatacttcagcgtgggtncgacgacggcccctaggacgaaggtcttggaggtgggagtggggaggtactcccgtccgtattcgttacgaacctaaaccgacaacccacgacaaccaacgtaacgtccgacgacacgtaactcgaacgtacgtacccggacaacacgtaccgagacacaacngtacctagagtacggagtacgtaggaacggttacgaccgtaaggtaacgtacgttacggaccggtaaacccgaaccggtaaccgggttcccggtttaagtttaaccgtttccggtaggggttacccggtagggtaaacggggtacggggggtaacgggaccccgggggtagggggtaccccgggtttagggggtttaacgggtttaaaaccggggttcggggttcgtttaaacggtttttcggaaggtttaccggttaacggggtttacccgggggaaaaccgggg

SEQ ID NO: 378594 - DNA, 720 bp, Homo sapiens
  misc_feature: GZ8MTXP02HMZNN.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttcgtggagcaccttcagcacctatacttcagctgggtgcgacgacggcccctggacgaggtcttggagtggagtggggaggactcccgtccgtattcgttaggaccaaaccacaccctacgacacacgtaacgtccaaggacagactacacgtactaccgacgaacaactccagacgactaacagtactacagtaggagagtagaagttacgaccgtaggtaagacttaccggtacgaccgaaccgtacccgggtaccgtttacgggtttaactttttcccggaggttacgggtaccggtaaaggggtaacgggggtacggggggtaccccggaacggggggttccggtttaaccccgggggtttaagggggtttaaaaccggggttttaagggggtttcccggtttacggtttttttaacggggaaagttttaccgggtttaccgggggtttaacggggggtaaaacccccgggg

SEQ ID NO: 378595 - DNA, 651 bp, Homo sapiens
  misc_feature: GZ8MTXP02ICGAC.38.26.C04.1.454.CMB.2.raw
  modified_base (242)..(242): a, c, t, g, unknown or other
  modified_base (282)..(282): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctggtctcggtgaagtcccctgcaggcttcnggaggcaccttcagcacctatacttcagctgggtgcgacncggcccctggacagggcttgagtggagtggggaggactccgtacccggtattccgtttagggacctaaaacccactaacccctaccgaccaacaaccgtaaacgttcccgaagggaccaaggaacctaccgaaccggtaactttaccccggacgaaccggaaactacccgaacggaacgaccaacgacgttacctacgtaagtagggagtataggaagttacgcctaggagtatcgtagaccgacgacggtccgttgttactttcgtgtcggacggaggacgggacggggccggaggggtccgttcggggttaaggtacggttaagggtcgttcgttttaggacgtttacgtcggttacggggaaccgg

SEQ ID NO: 378596 - DNA, 605 bp, Homo sapiens
  misc_feature: GZ8MTXP02JUMOX.38.26.C04.1.454.CMB.2.raw
  modified_base (322)..(322): a, c, t, g, unknown or other
  modified_base (429)..(429): a, c, t, g, unknown or other
  modified_base (464)..(464): a, c, t, g, unknown or other
  modified_base (470)..(470): a, c, t, g, unknown or other
  modified_base (497)..(497): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacgacggtccgtgttatttcgnggtgcggaggagggacgggggccgaggggtccgtcgggtacgggtaacgttaggtgtcgttttgattagtcgtggggaccaagggacaagtcggccaccgtctcctncgcctccgacgacggcccagtccggtcctccccgngacccnccctcctacgacgacgccgaccgtcgngggccacgcgccggcccgtggctacggccgtcggtaccgaacggtaccttaccgtccgtacgtacgaacgttccgaacgttgggaccggtccggggcgtacggaaccg

SEQ ID NO: 378597 - DNA, 655 bp, Homo sapiens
  misc_feature: GZ8MTXP02ILFJ2.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagctgagatctgacgacacggccgtgtattctgtgcgagaggaggggccaggggctcggtggtaacgttaggtgtcttttgattagtcggtaggggacaaagggggacctaagttcgggtacctacccggtccttcctaccgacgccctacccgaacccgaacgggcccctaacgtccggttacccttcccccgtcggacccctacccccgttcctacccgaaagaccgtacctaaccccgtcggtcgggggaccaaccggacggcccgggcccgtcggggcctcggcccgttacggtaccgaaacggtaccttaaccgttcccgtaacgtcgtaacgtccgacgtcggacggccgggtacgtacggaacgg

SEQ ID NO: 378598 - DNA, 581 bp, Homo sapiens
  misc_feature: GZ8MTXP02JTNAX.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagaagcctgggtcctcggtgaaggtcccctgcaaggcttcgtggaggcaccttcagcacctatacttcagctgggtgcgacacggcccctggacgaaggcttggagtggagtggggaggactcccgtccgattcgttggaccaaaccacacctacgcacacagtccagcagactcacgataccgcgacaatccacgagcacagtcacagtggagatgaagtcgcctagagatcgtagacgacgtaccgggccgttaggttatttcgtgtacggacggaaggaggggtacgggggacccgaagggggcgttacggggtaggttaaaccggttaagggtgttacgttttaggagttacgtcggtacggggaaccgg

SEQ ID NO: 378599 - DNA, 573 bp, Homo sapiens
  misc_feature: GZ8MTXP02ID9SS.38.26.C04.1.454.CMB.2.raw
  modified_base (284)..(284): a, c, t, g, unknown or other
  modified_base (495)..(495): a, c, t, g, unknown or other
  modified_base (506)..(506): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttcgtggaggcaccttcagcacctatactttcagctgggtncgacacggcccctggacaagggcttggagtggagtggggaggactcccgtcccgatcgtttggaccaaaccacaccctacgcaacactaacgttccaaggacacgacctcgaaccgacgttaccggcggaacaactccgacgacgcacagtactacatacggagatgagtacgccgtgacgatcgtagacgacacggtccgtgtatttcgngcgtacgaggngggacggggccgaggggccgtacgggtggtaacgttggtcgttcgtttgattacgtcggtgggaacg

SEQ ID NO: 378600 - DNA, 651 bp, Homo sapiens
  misc_feature: GZ8MTXP02IR3GS.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcgggtgaaggtcccctgcaaggcttcgtggaggcaccttcagcacctatactttcagctgggtgcgacaggccccgtggacaagggcttgagtggatgggaggatccctccgatcgtttggacaaaccacacctaccgcacacaattccagcagactcacgattaccgacggacgaaactccgaacgacgacacacgtactaccagtaggagagtagaagtagccgtagtacgatacgtacgaccgtacgaccgggtccgttagttaacgtttccgtagtacggtaccggagggaacggggacggggggaccggtacggggggtaccggtttaccgggggttaacggggtttaaaccgggtttaaggggttcggtttaccgtttttacggaagtttaccgggttacggttaccgggggtaaaacccgggg

SEQ ID NO: 378601 - DNA, 653 bp, Homo sapiens
  misc_feature: GZ8MTXP02G40OB.38.26.C04.1.454.CMB.2.raw
  modified_base (278)..(278): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtccctgcaaggcttctggaggcaccttcagcactatacttcagctgggtncgacaggcccctggacaagggcttggagtggagtggggagggactcccgtacccggattccgtttggaccaaaccacaccctacgacaacacaacgttccaggacacgactaccgacgtacttacccggacggaaaccgaaactcccgaacgacgaccaacgtacgtactaacagtacggaagagtagaacggtagccgtagagactcgtacgaaccgacgacggtaccgttagttacgtttcgtaggtacggacggagggaggggtacgggggaccggacgggggtacgttaccgggggtacgggtttaaaccgggttggggttcggtttacggttttacgtaagtttacggtcggttacgggggtaaacccgg

SEQ ID NO: 378602 - DNA, 537 bp, Homo sapiens
  misc_feature: GZ8MTXP02JF8B5.38.26.C04.1.454.CMB.2.raw
  modified_base (205)..(205): a, c, t, g, unknown or other
  modified_base (317)..(317): a, c, t, g, unknown or other
  modified_base (357)..(357): a, c, t, g, unknown or other
  modified_base (437)..(437): a, c, t, g, unknown or other
  modified_base (491)..(491): a, c, t, g, unknown or other
tcagtcgatcacgtcacgaccggtgctcgatttagtctagcgactttgggtttggggatggttttctcgatggggctgggagggctttgttggagaccttgcacttgtactccttgccattcagccagtcctggtgcaggacggtgaggacgctgaccacacggtacgtgctgttgtactgctcctcccgatctttggcaaaccncactacgcacacaagttccaggacagactcacgattaccgcggacgaatccacgagcacagtctacatggagatgagtagcctgagatctgacgacacggccgtgtatttcngtgcgagagaggggccaggggctcggtggtaacgttggtncttttgatatcgtgggggccaaaggggaccaagtggtcaccgtctctcacgcctcaccaaggcccatcggtccttccccnggcaccctcctccagcgcacctcgtacggggcacacgcggccctgggctcgccnggtcaggactacgttccacgtgaactcgactcgacgcggctggacg

SEQ ID NO: 378603 - DNA, 709 bp, Homo sapiens
  misc_feature: GZ8MTXP02F94UX.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttcgtggaggcaccttcagcctacctatactttcagcgtgggtgcgacacggcccctggacaagggcttggaggtggagtggggaggactcccgtcccgtattccgtttacggaccaaaacccgacacccgtaacgccaacaacgtaaacgttcccgaaggaccgaacgacctaccgaaccgtaacgttaacccggacggtaaccgaaactacccgaacgagaccacagtactacgtagtacggaagtagtacggtaaagtacggacccgtaggaagtacttaccggtacgaaacccggaacgaaccggggtcccgtttaggttaactttccgtaggttcggacgggaagggacgggggtacgggggacccggtacgggggtaccgttcgggggtaacgggttaaccggttaaggggttacgttacggtttaggaactttcggtaccggggttacggggtaaaccgg

SEQ ID NO: 378604 - DNA, 530 bp, Homo sapiens
  misc_feature: GZ8MTXP02HTBDP.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggcaccttcagcacctatacttcagctgggtgcgacaggcccctggacaagggcttgagtggatgggaggatcctccgatcttggcaaaccacacctacgcacacaagttccagcagactcacgataccgcgacaatccacgagcacagtctacatggagatgagtagcctagagatctgacgacacggccgtgtattcgtgcgcgaggaggacgggggccgaggggcgtcgggtaggtaacggttaaggtgtcgttttgagttacgtcgtggggtaaccg

SEQ ID NO: 378605 - DNA, 637 bp, Homo sapiens
  misc_feature: GZ8MTXP02H9YLV.38.26.C04.1.454.CMB.2.raw
  modified_base (248)..(248): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttcgnggagcaccttcagcacctatacttcagcgtgggtgcgacgacggcccctggacaagggcttggagtggagtggggaggctcccgtcccgattcgttcggactaaaccacaccctacgaccacacgtaacgtccgaggacacgactacgaccgtacgttacccgacggtaacgaactcccgacgacgcaacacgtactaacagtggaagtagtagaagtacgtcctaggagtacgttacgacgaacccgacggtaccggtccggttagtttacgttccgtaggtcggacggaggggaaacgggcgggggaccggaaggggtccgtccggggttaaggtaacgggtttaaggtgtttcgtttagacgtcggttacggtacggggtaaccgg

SEQ ID NO: 378606 - DNA, 605 bp, Homo sapiens
  misc_feature: GZ8MTXP02IX2RT.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggcaggggctcggtggtaacgttaggtgtcgtttttgattatcgtggggaccaaggggacaagtcggtcaccgtctcctcacgcctcccaaccgaacgggcccacgttccggtcccttcccccgtcggcccaccccttccctacccgaacgacgccaacccgtcgtcgggggacaccgacggcccggcccgtgggcctcggcccgttggtacaacggtaccttaccgttccgaacggttgaacgtccgaacgtcggacggcgggtcgtcggacg

SEQ ID NO: 378607 - DNA, 579 bp, Homo sapiens
  misc_feature: GZ8MTXP02HIWJ2.38.26.C04.1.454.CMB.2.raw
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaaggcttgagtggagtgggagggatcctcccgatcgtttggaccaaaccacacctacgcaccacaacgttaccaggacagactcacgataccgcgacgaactccacgagcacagtctacataggagatgagtagcctagagatacgtagacgacgacggtccgtgttattcgtgtcgacggaggagggacgggggaccgagggggtccgtcggggttacgggttaacggtttaagggtggttaccgttttacggagtttacgtcggttacggggtaaccgg

SEQ ID NO: 378608 - DNA, 612 bp, Homo sapiens
  misc_feature: GZ8MTXP02I6Z1Z.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttcgtgggaggcacccttcagcacctatacttcagctgggtgcgacacggcccctggacaagggcttggaggtggagtggggagggactcccgtcccgatcgttggacaaaccacacctacgcacacagtccagcagactacacgactaccgacgacaactccacgagcacagtctacagtggagatgaagtacgcctagagtagtcgtagaaccgtacgaccggtccgtagttacgtttaccgtggtacggacggaagggaggggaacgggggaccgaagggggtccgttacgggggttacggttaaacgggttaaggggtacgttacggtttttaggacgtttaacggtcgggttacgggggaaacgg

SEQ ID NO: 378609 - DNA, 592 bp, Homo sapiens
  misc_feature: GZ8MTXP02H8APG.38.26.C04.1.454.CMB.2.raw
  modified_base (280)..(280): a, c, t, g, unknown or other
  modified_base (285)..(285): a, c, t, g, unknown or other
  modified_base (398)..(398): a, c, t, g, unknown or other
  modified_base (426)..(426): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctcttttgtggtggcagcagctacaggtgtccagtcccaggtgcagttggtgcagtctggggctgaggtgaagagcctggtcctggtgaaggtcccctgcaggcttcgtggaggcaccttcagcacctatacttcagctgggtncgacncggcccctggacagggcttgagtggagtgggaggactccctcccgatcgtttggacctaaaccgacacctacgcacacagttccagcagactcgacgacttaccgacgacaanccgagacgcacagtctacagtgagacgngaagtagcctggagacttcgaggaccgacgacggccgttagttactttcgtacgtgacggaggacgggacgggggaccggacgggggtcgtaccggggttgggtttaaaccggttaagggtcggttacgttttaggagttaccgttagggtacgggggtaacccgg

SEQ ID NO: 378610 - DNA, 608 bp, Homo sapiens
  misc_feature: GZ8MTXP02GITL5.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacacggcccctggacaaggcttgagtggagtgggagggatccgtccgatcgtttggcaaaccacacctacgcacacaacgtccaggcagactcacgatacgcgacatccacgagcacacgtctacagtcggagtatgagtagccgttaggagtactcgtagaaccgaccgacgggtccgttagttatttccgtgttacggacggtagggaggggacggggggtccggaacgggggtccgttacggggttacggggtttaaaaccggtttggggtcgtttacgtttttaggacggtttacgttccgggttacgggggaaaccggg

SEQ ID NO: 378611 - DNA, 613 bp, Homo sapiens
  misc_feature: GZ8MTXP02ICEHT.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctggtcctggtgaggtcccctgcaaggcttcgtggaggcaccttcagcacctatacttcagctgggtgcgacgtacggccccgtggacaagggctttggaggtggagtggggagggactcccgtccgtatcgtttacggacctaaaccacaccctaccgccacactaagttccgaggaccagactaccgacgtactaccgcgtaaccgaactccgacgacgacaacgacgtactacgagtaggagatggaagtacgaccgtagaagtatcgtacgacgaacgacgggtccgtaggttattcgtagtcgacggaggagggacgggggccgacgggggtccgtcgggttaggttaacggttaaggttcgtacgttttgacgtttacgtacggtacgggaaccgg

SEQ ID NO: 378612 - DNA, 587 bp, Homo sapiens
  misc_feature: GZ8MTXP02GNAUL.38.26.C04.1.454.CMB.2.raw
  modified_base (348)..(348): a, c, t, g, unknown or other
  modified_base (372)..(372): a, c, t, g, unknown or other
  modified_base (374)..(374): a, c, t, g, unknown or other
  modified_base (415)..(415): a, c, t, g, unknown or other
  modified_base (467)..(467): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctcggtgaacggtcccctgcaaggcttcgtggaggcaccttcagcacctatactttcagctggtgcgacaggcccctggacaggcttgagtggagtggggaggactccgtccgattcgtttggacaaaccncactacgccacacagtcaggacancncacgactaccgcgacaatccagacgcacagtcacagtgganagtagagtagcctagagtatcgtgaacgacgacggccgttagtacgtttcgngtacgacggtaaggacgggacgggggacacgggggtcgtacggggttacgggtaacggttcgggttacgttcgttttaggaagtttcggtacgggtcggggtacccgaaagggggtaacg

SEQ ID NO: 378613 - DNA, 547 bp, Homo sapiens
  misc_feature: GZ8MTXP02GKP84.38.26.C04.1.454.CMB.2.raw
  modified_base (476)..(476): a, c, t, g, unknown or other
  modified_base (544)..(544): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgataatcgtgggggccaaaggggacaaatgggtcaacccgtctcctcagcctccacccaaagggcccaatccggtcttcccccctggccaccctccctccaaagagcaccnctgggggcacagcggccctgggctgcctggtcaaaggactacttccacgtgaatcgactgagcggcgngcg

SEQ ID NO: 378614 - DNA, 711 bp, Homo sapiens
  misc_feature: GZ8MTXP02FW14S.38.26.C04.1.454.CMB.2.raw
  modified_base (350)..(350): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggcttcgtggagcaccttcagcactatacttcagctgggtgcgacacggcccctggacaagggcttgagtggagtggggaggctccctccgattcttggactaaaccncacctacgcacactacgtccaaggcagactacgacgtacgttaccgacgacgaactccgacgacgacgactacgtaccacgacgtaggagagtacgtaacggtacgtccctaggaacgtacttaccgacggaaacccgtaccggaaccgggtccccggtttaggttaacgtttttccggtggttaccgggtacgggaagggtaacgggggtaaccggggggtacccggaaacggggggttccgtttaaccgggggggttaacggggttttaaaaccggggttttgggggttacggtttaaccggttttttacggggtaagtttaccgggtttaccggggtacgggggttaaaacccccggg

SEQ ID NO: 378615 - DNA, 537 bp, Homo sapiens
  misc_feature: GZ8MTXP02JBVMY.38.26.C04.1.454.CMB.2.raw
  modified_base (428)..(428): a, c, t, g, unknown or other
tcagtcgatcacgtcacgaccggtgctcgatttagtctagcgactttgggtttggggatggtttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgagatgagtagcctgagatctgacgacacggccgtgtatttctgtgcgagagaggggccaggggctcggtgtaacgttaggtgcttttgatatcgtggggccaaagggacaagtggtcaccgtctcctcagcctcaccaggcccatcgtctcccngcacctcctcagacgcacctcgtcggggcacgacgcggccgtgggctcgccgtggtcgaaacggactaccgttccgacgtgaacgtcgacgtcgacgcggcgtggaccg

SEQ ID NO: 378616 - DNA, 694 bp, Homo sapiens
  misc_feature: GZ8MTXP02JK6X4.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggagcacttcagcacctatacttcagtctgggtgcgacaggcccctggacaagggcttggagtggagtgggagggatcccgtccgtatcgtttggcaaaaccgcacctacgcacacaagttccaggcacgactcacgtaattacccgacggtacaaactccgaaacgagaccaacaacgtactaaccaagttacggaagagttggaaacggtacgacccgttaggaagacttagtacgaaaccgtacggaaccggtccgttagtttaaccgttttacgtcggttaggtacccgggtaagggtaacgggggaaaccgggggggtccaaacgggggggtcctttaacccggggggttaagggtttaaaaccgggggtttaaggggtaccggtttaccggtttttcggaaaagtttaccggtttccggggaggggggtttaaaaccccgg

SEQ ID NO: 378617 - DNA, 593 bp, Homo sapiens
  misc_feature: GZ8MTXP02JIXKW.38.26.C04.1.454.CMB.2.raw
  modified_base (353)..(353): a, c, t, g, unknown or other
  modified_base (421)..(421): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaaggtccctgcaaggcttctggaggcaccttcagcacctatacttcagtctgggtgcgacacggcccctggacaagggcttggaggtggagtggggagggactcccgtccgatcgttggacctaaaccncactacgcacacagtccagcagactcacgataccgcgacgactccacgagactacagtacacagtganatgagtagcgtagagatcgagaacgacgtaacggtccgtggttaattttccggtgtacggacggagggacggggacgggggaccggtacgggggtaccgttacgggggttaacgggttaacgggttggttacggttacgtttacggagttacggtacgggtacggggaaccg

SEQ ID NO: 378618 - DNA, 706 bp, Homo sapiens
  misc_feature: GZ8MTXP02JKAHA.38.26.C04.1.454.CMB.2.raw
  modified_base (277)..(277): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccagagcacagtctacatgganatgagtagcctgagatctgacgacgacggtccgtgttactttctggtgacggaggagggacgggggccgagggggtcgtacggggttacgggttaaacggtttaggtcgttctttttaggattacgtcgggtcgggggaacccgtaaagggggtactaaaggtcgggtaccctacccggttcctccgttaccgacgtcccctacccgaaacccgtaaacggggccccctaacggttccccggttccccttccccccgtcgggtacccctacccccgttcctaacccgaaacggaccgcccgtacccgtcgggtccgggggaccacggaccggtccggtcccgtcgggacttccggccgttacggtaccgaacggtacccttaccgtacccgacgtcgaacgtaccggacgtggcggcggtcgcggaacg

SEQ ID NO: 378619 - DNA, 577 bp, Homo sapiens
  misc_feature: GZ8MTXP02JLJH9.38.26.C04.1.454.CMB.2.raw
  modified_base (348)..(348): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaaggcttgagtggagtggggaggatcccgtccgatctttggcaaaaccncacctacgcacacaagttccaggcagactcacgattaccggcgacgaactccacgagcacagtactaccagtaggagatagagtacgcctagaagatacgtagaacgaccgaccgggtccgtagttacgtttacgtggtcgacgagggagggacgggggccgagggggccgtacggggtaggttaacggttaagggtcgttacgtttggattacgtcggtggggaaccg

SEQ ID NO: 378620 - DNA, 596 bp, Homo sapiens
  misc_feature: GZ8MTXP02FL0XN.38.26.C04.1.454.CMB.2.raw
  modified_base (283)..(283): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtncgacacggcccctggacaagggcttgagtggatggggagggatcccgtcccgattcgtttggactaaaccacacctacgccacacaagttccaggcagactcacgattaccgcggaacgaactccgcgagcacagtcgtacagtcggagatggaagtacgaccgtgagattcgagaaccgacgacggtccgtagttacttctggtacgacggaggagggacgggggccgacgggggtcgtaccgggggtaggttaaacgggttaagggtggttacgttttaggaacgtttacgtacggttaggggaaaccggg

SEQ ID NO: 378621 - DNA, 698 bp, Homo sapiens
  misc_feature: GZ8MTXP02JDUQ1.38.26.C04.1.454.CMB.2.raw
  modified_base (352)..(352): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcacttcagcacctatacttcagctgggtgcgacaggcccctggacaaggcttggagtggagtggggaggctcccgtccgattcgtttaggaccaaaccncacctacgacaaccactaacgttccaaggaccagacctacaaccgtacttaacccggacggaacgtaaactcccgaaacggacgacgaccgtaacgtacctaacgagtaggaagtagtaggtaacgtacggtaccgttagaacgtacgttacggtacgaaccggtaaccggtaacgggtcccgttaggtttacgttccgtggttacggaccgggtaaggaacgggggacgggggaccggtaacgggggtaccggtttacgggggtaaccgggtttaaaacgggttgggttcggtttaccggttttacggaaggtttaccggttcggggtacggggtaaaacccggg

SEQ ID NO: 378622 - DNA, 633 bp, Homo sapiens
  misc_feature: GZ8MTXP02G9GLD.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctggtgaacggtcccctgcaaggcttcgtgggagccaccttcagcacctatacttcagcgtgggtcgcgaccgacggcccctaggaacgaagggtcttggaggtggagtggggaaggtactcccgtaccgtattcgttacggaccaaaccgacaccgtacgaccacaacgaacgttaccgaagggaccacgactaccgaaccgtacgttaccggacgaaacgaacacccgaaacggacgaccacaacgtactaacgagtaggagagtaggaagtacgaccgtagagatacgagacgacgacggtcgttagtactttcgtggagacggaggagggacggggccggtaaggggtcgtacgggtacggttaacggttggtcgttacgtttagagttcggtacggtacgggaaccgg

SEQ ID NO: 378623 - DNA, 634 bp, Homo sapiens
  misc_feature: GZ8MTXP02F7ZWX.38.26.C04.1.454.CMB.2.raw
  modified_base (283)..(283): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagcctgggtcctcggtgaacggtcccctgcaaggtcttcgtggaggcaccttcagcacctatacttcagctgggtncgacacggcccctggacgaggcttgagtggagtggggaggactcccgtccgattcgttaggacaaaccacacctacgcacacagtaccagacagactcacgctaccgcgacatcccgacgacgacacgagtacacagtcggaagagtagagtacgcgtagagtatacgtagaaccgaccgacgggtccgttagttactttacgtcggtggacggtaagggacggggaccgggggtccggtaacgggggtcggttaccggggtttaggggtttaaccggtttaaggggttacggtttaccggtttttaggtaacggtttacggtttaccggggttacgggggtaaacccggg

SEQ ID NO: 378624 - DNA, 626 bp, Homo sapiens
  misc_feature: GZ8MTXP02FRE1J.38.26.C04.1.454.CMB.2.raw
  modified_base (259)..(259): a, c, t, g, unknown or other
  modified_base (473)..(473): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctcttttgtggtggcagcagctacaggtgtccagtcccaggtgcagttggtgcagtctggggctgaggtgaagagcctgggtcctcggtgaaggtcccctgcaaggcttcgtggagcaccttnagcacctatacttcagtctgggtgcgacacggcccctggacaagggtcttagagtggagtggggaggtactcccgtcccgagttccgtttggaccaaaaccgtacaccctaccgccaaacactaacgttccgaagggccagacttacgaaccgacttaacccggcggaacgtaaactccgaacgacgacaacgtacgtactaacgagtacgganagtgaagtacgaccgtagagtattcgagaccgacgacggcgttagttatttcgtaggttcggacgaggagggacggggccggaggggtcgtacggggtacggtttaaacggttgggtgttacgtttagagtttacggcggtacgggtaaccgg

SEQ ID NO: 378625 - DNA, 523 bp, Homo sapiens
  misc_feature: GZ8MTXP02FF9HL.38.26.C04.1.454.CMB.2.raw
  modified_base (259)..(259): a, c, t, g, unknown or other
  modified_base (458)..(458): a, c, t, g, unknown or other
  modified_base (486)..(486): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttnagcacctatactttcagctgggtgcgacaggcccctggacaagggcttgagtggatggggagggatcctcccgatctttggctaaaccacacctacgcacacaagttccaggcagactcacgattaccgcgacgaaatccacgagcacagtctacatggagatgagtagcctgagatctgacgacgacgcgtgtattcngtgcgagaggaggggcgagggcgtcggnggtaacgtaaggtgtcgtttagatagtcgtgggaacg

SEQ ID NO: 378626 - DNA, 578 bp, Homo sapiens
  misc_feature: GZ8MTXP02IOCI2.38.26.C04.1.454.CMB.2.raw
  modified_base (320)..(320): a, c, t, g, unknown or other
  modified_base (343)..(343): a, c, t, g, unknown or other
  modified_base (397)..(397): a, c, t, g, unknown or other
  modified_base (414)..(414): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctgggtcctggtgaacggtcccctgcaaggcttctggagcaccttcagcacctatacttcagctggtgcgacaggcccctggacgaaggcttgagtggagtggaggntcccgtccgatcttggcaaaccncacctacgcacacacgtcagacagactacacgacttacgacgacgaatcacgancacagtacacagtgaanagtgagtagaccgtagagatcgtagaccgacgacgggtccttggttaactttcgtggaccggacgtacggggagggacgggggaccgaacgggggcgtacggggttacggttaaacggttaaggttcgtgttttacgagttacggttcggtacgggtaaaccgg

SEQ ID NO: 378627 - DNA, 720 bp, Homo sapiens
  misc_feature: GZ8MTXP02GFTBM.38.26.C04.1.454.CMB.2.raw
  modified_base (316)..(316): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggcgtagtatttnggtgcgagaggaggggccaggggctcgggtggtaacgttaggtgtacgtttttgacttagtcgttcgggggacccaaagggggtaacaagttcggggtcctaaccggttcccgtcccgttaccacggccctcccgaaacccgtaacggggcccctaacgtcccgggttcccgttcccccccgttacggggacccctaaccccccgttacccttaccccgaaacggaccgtaccgtaaccccgttccgggacggggggaccctaaaccggacgggtcccgggccccgtccgggggtccttccgggcccgttcgggtaccgtaaacggggtaccttaccgttaccccgtacggtagtaaccgttacggtaaccgtggggaacggtcggggacgttcggggaaccgg

SEQ ID NO: 378628 - DNA, 648 bp, Homo sapiens
  misc_feature: GZ8MTXP02GXA36.38.26.C04.1.454.CMB.2.raw
  modified_base (550)..(550): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagccgtgggtcctcggtgaacggtcccctgcaaggtcttcgtggaggccaccttcagcacctatacttcagtcgtgggtcgcgacgacggcccctaggacgaaggcttggaggtggagtggggacggactcccgtccgtattccgtttaggacctaaaaccgacaacccgtaccgacaacaacctaaggttacccgaagggacacgtactacgaacgtacgtaccggacggaaaccgaactcccgaacgacgacactacgtacctaacgagtaggaagtagtagaagtacgccgttaggagtactcgtacgacgacgacggtcgtagttagttcgtagnggtacgacgggaggacgggggtccggacggggtcgtacggggtaggtttaacggtggttcggttacgtttaggacttacggtcggtacgggtaaccgg

SEQ ID NO: 378629 - DNA, 610 bp, Homo sapiens
  misc_feature: GZ8MTXP02HP7GK.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagagaggggccaggggctcgggtggtaacgttaggtgtctttttgattagtcgtggggaccaaagggacaagtcggtacacccgtctcctcacgcctccacccgaacgggcccagtccggtccttcccccgtcggccacccctcctaccaagacgtccacctcgtcgggggccacgacggccggcccgtcggggcctcggtccgtcgggtaccgtaaacgggtaccttaccttcccgtaacgtcgtaacgttccgaaccgttggacggtccggggacctgggaaccg

SEQ ID NO: 378630 - DNA, 612 bp, Homo sapiens
  misc_feature: GZ8MTXP02IVGG7.38.26.C04.1.454.CMB.2.raw
  modified_base (278)..(278): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacgacggccgtgtatttctgtgcgagaggcggggcaggggctcggtggtaacgttagtgtcttttgattatcggtcggggaccaaaggggaccaagtcgggtacaccgtctcctcacgcctccaaccgacgggccctacgttcccggtcccttcccccgtcggcccacccctcctaccaacgaccgcacccgttcggcggggcacgacggtccggcccgtgggccctcggccgttcgggtaccaacggtacttaccttaccgtacgtacgtaacgtaccggacgttcggacggccggggtcgtcgggaaccg

SEQ ID NO: 378631 - DNA, 609 bp, Homo sapiens
  misc_feature: GZ8MTXP02IR9T6.38.26.C04.1.454.CMB.2.raw
  modified_base (206)..(206): a, c, t, g, unknown or other
  modified_base (278)..(278): a, c, t, g, unknown or other
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctattgtactgctcctcccgatctttggcaaaccncactacgcacacaagttccaggacagactcacgattaccgcggacgaatccacgagcacagtctacatgganatgagtagcccgagatctgacgacacggccgtgtatttcngtgcgagaggaggggccaggggctcggtaggtaaccgttaggtgtcttttgattagtcgtgggggaccaaagggactaagtcggtcaccgtctcctcgacgccctaccaccgaacgggccctacgttccggtcccttcccccgtggcccctaccccttcccgtacccgaaacgtcgacctacccgttacgcggggaccaccgacggccggtcccgtcgggctcgccgtcggtaccaacggtacctacgttccgacgtcgacgtcgacgtcggacgcggctcggacgaacgg

SEQ ID NO: 378632 - DNA, 600 bp, Homo sapiens
  misc_feature: GZ8MTXP02FOVNM.38.26.C04.1.454.CMB.2.raw
  modified_base (436)..(436): a, c, t, g, unknown or other
  modified_base (453)..(453): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacacggcccctggacaagggcttggagtggagtgggaggactcccgtccgattcgttcgacaaaccacacctacgcacactacgtccaggcagactacgacgtacttaccgacggacaactccacgacgacacagtactacagtagganagtgagtcgacgtgagntcgtagaccgacgacggtccgttagtactttcgtgtcggacggaggacggggcgggggaccgagggggtaccgttacggggttacggttaaacggttggttacggttacgttttaggacgtttaggtacgggtacggggtaaaccgg

SEQ ID NO: 378633 - DNA, 646 bp, Homo sapiens
  misc_feature: GZ8MTXP02JIO6O.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgataccgcggacgaatccacgagcacagtctacagtggagatgagtagcctgagatctgacgacacggtccgtgtatttcgtgtgcgaggaggaggggccgaggggctcgggtacggtaacgttggtgtcgttttagattagtcggtcggggaccgaaagggggtacaagtcgggtaccacccggttcctccctcgacgtacccgtcccaacccgaacggcccctacggtcccggtcccttcccccgcggtcccaccccctcccgtacccaacgtaccgaccgtaccgtcggtaccgggggaccacggacggcccggcccgtcgggccgtcggcccgtcgggtaccgaaacggtacctaccgtaccgacgttacgaacgtcggacgtacggacggcggtcgacggacg

SEQ ID NO: 378634 - DNA, 585 bp, Homo sapiens
  misc_feature: GZ8MTXP02F98UF.38.26.C04.1.454.CMB.2.raw
  modified_base (281)..(281): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctggtcctggtgaaggtcccctgcaaggcttctggaggcaccttcagcacctatactttcagctgggtncgacaggcccctggacaaggcttgagtggagtggggaggactcccgtcccgattccgtttacggcaaaccacacctaccgcaacacaacgttccaagacagacctcgacgacttaaccgcggaacaactaccacgagcacagtactacataggagatgaagtaggcctagagatacgtagaccgacgacggccgttagtactttcgtgtacgcggaaggagggacgggggaccgacgggggtcgtacggggtagggttaacggttaagggtcgtacgtttaggattacgtcgtaggggaaccgg

SEQ ID NO: 378635 - DNA, 606 bp, Homo sapiens
  misc_feature: GZ8MTXP02GOXO9.38.26.C04.1.454.CMB.2.raw
  modified_base (452)..(452): a, c, t, g, unknown or other
  modified_base (508)..(508): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacacggcccctggacaaggcttgagtggagtggggaggactcccgtcccgattcgtttaggacctaaaaccgacaccctacgccaacaccaagttcccaaggaccagaacctcaacgtacttacccggacgaacgaaatcaaacgagcaacagtctaacagtggaanagtagagtacgccgtagagtattcgagaaccgacgacggtccgtgttaagtttcgnggcgacggaggacgggacgggggaccgacgggggctacggggttaggtaacggttaaggtgttacgttttaggagttacgtcggttacggggaacccg

SEQ ID NO: 378636 - DNA, 615 bp, Homo sapiens
  misc_feature: GZ8MTXP02I2DHK.38.26.C04.1.454.CMB.2.raw
  modified_base (379)..(379): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaacggtcccctgcaaggcttcgtggaggcaccttcagcacctatactttcagctgggtgcgacacggcccctggacagggcttgagtggagtggggaggactcccgtccgattcgttcggacaaaccacacctacgcacacagtccagcagacncacgataccgacgacaactccgacgagcaacagtactacgagtggaagtatagagtcgaccgtagacgtatcgtagacccgacgaaccggtccgttagttactttcgtacggttcgtaccggaggacggggacgggggccggtaacgggggtccgttacgggggttacgggttaaacggtttaagggttcgttaccgttttaggacgtttacggttcggtacgggggtaaacccgg

SEQ ID NO: 378637 - DNA, 744 bp, Homo sapiens
  misc_feature: GZ8MTXP02JU6O1.38.26.C04.1.454.CMB.2.raw
tcagtcgatcacgtcacgaccggtgctcgatttagtctagcgactttgggtttggggattacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggagccaccttcagcacctatacttcagcgtgggtcgcgacgacggccccctggaccgaagggtcttggaggtggagtggggaggtactcccgtacccggtattccgtttacggacctaaaacccgactaccgtacccgaccaaccaacgtaacgttccgaacggacacgacctaccgaaccgtaacgttaacccgacggtaaaccgaaacgtacccgaacggacgaccaaccgtaacgtacctaacgtaacgtacgggaagtaagtaggtaaacggttacggccgttaggacgtacgtacgtacggaaccggaccgtaccgggtaccggtttaggtttactttccggtaggtacgggaccggtaacggggtaggggacgggggaccgggtcgggggttaccggttaccgggggttaggggttaaccgggtttagggtcggttacggtttttaggagtttacgggtccgggtttacggggaaccggtaaacgggg

SEQ ID NO: 378638 - DNA, 692 bp, Homo sapiens
  misc_feature: GZ8MTXP02IXL9W.38.26.C04.1.454.CMB.2.raw
  modified_base (440)..(440): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatacttcagctgggtgcgacacggcccctggacaagggcttgagtggagtgggaggatccgtccgatcgtttggacaaaccacacctacgaccacactaagtcccaggacagactacacgattacccgacggacgaactccgaacgacgacaacgacgtctaacatcggaanagtgagtagaccgtaggaacgtataccgtagaaccggtaacgacggggtaccggttagttaacgttttccgtggttacggtaccgggtaaagggtaacggggaacggggggaccccgtaaaggggggtcccggttaaccgggggtttacggggtttaaaaacccggggttttaacgggggtttggtttacccggtttttaggggaaacgttttaacgggttccgggtttaaccggggggttaaaccccgggg

SEQ ID NO: 378639 - DNA, 644 bp, Homo sapiens
  misc_feature: GZ8MTXP02FT59C.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctagagatcgtgaccgacgacggtccgtgttactttcgtggtcgcggaggagggacgggggccgaggggtcgtcggggttaggttaaacggtttgggtgttctttttagattagtcggtggggaccgaaagggactaagtcggtaccaccgttctcctacacgtccctacccaaccgacggcccctagtcccgttcccttacccccgtgacccctaccctccgtaccgaagcgacccaccgttcggcggggaccacggacggcccggccgtgggcctcggccgtacggtaccgaaacggtaccttaccgttccgaacgtcgaacgtaccgaacgtcggacggtcgggacgacggaccg

SEQ ID NO: 378640 - DNA, 562 bp, Homo sapiens
  misc_feature: GZ8MTXP02I97TG.38.26.C04.1.454.CMB.2.raw
  modified_base (449)..(449): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcactagtctacatggagatgagtagcctgagatctgacgacacggcgtgtatttctgtgcgagaggacggggcaggggctcggtggtaacgttaggtgtcgttttgattatcggtggggaccgaagggacaagtggtcaccgtctcctcacgcctccaccgaacggcccagtccgtcccttccccgngcccaccctcctaccaagacgcacccgtcgtcggggcacgacgccggccgtggctcgcgtggacgaacgacctactccgcgtcgaacgtcgacgtcggacgtcggctcggacg

SEQ ID NO: 378641 - DNA, 719 bp, Homo sapiens
  misc_feature: GZ8MTXP02GNL8I.38.26.C04.1.454.CMB.2.raw
  modified_base (499)..(499): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcaggtcgtggggctggaggtgaagagccgtggtcctggtgacggtccctgacaggtcttcgtggacgctaccttcagccacctatacttcagtcgtagggtcgcgaccgacggcccctaggacgaagggtcgttggacggtggaggtggggacggtactcccgtccgtagttcgttacggaccaaaccgactaacccgtacgaccaactaacgtaacggttacccgaaggaccgacgacctacgaaccgtacgttacccggacggtaaaccgaactacccgaacgagaccacgacgttacacgtagaggaanagtacgaacgtacgtaccgagtaagtactcggaacgaccggtaaaccgccgggttcgttacggtttacgtttccggacggacccgggaagggtacggggaacggggggtaccgggggtaacggtaacgggggttccgttaacgggggttaagggtttaaccgggttaagggttcgtttacggtttaggagtttaccggtcggggttaacggggaaaccgg

SEQ ID NO: 378642 - DNA, 663 bp, Homo sapiens
  misc_feature: GZ8MTXP02IPNJL.38.26.C04.1.454.CMB.2.raw
  modified_base (358)..(358): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgacggtcccctgcaaggcttcgtggaggcaccttcagcacctatactttcagtctgggtgcgacgacggcccctggacaagggcttggagtggagtggggagggacttcccgtccgattcgttggccaaaaccncacctacgcacacaacgttccaggcagactcacgacttaccggacggtaacgaactccgacgacgacacgacgtactaccagtaggaagagtacggagtacgtccgtaggagtactacgtaccgaaccgaccgtaccgggtcggttagttacgttttccgtgttcggaccggtaggacgggggacgggggcccggtaagggggtccggttacgggggttacggggttaaaacggggtttcgggtttcggttacggtttttagggaacgtttacggttaccggggttacgggggtaaaacccgggg

SEQ ID NO: 378643 - DNA, 689 bp, Homo sapiens
  misc_feature: GZ8MTXP02IXI9P.38.26.C04.1.454.CMB.2.raw
tcagtcgatcacgtcacgaccggtgctcgatttagtctagcgactttgggtttggggatggttttctcgatggggactgggagggctttgttggagaccttgcacttgtactccttgccattcagccagtcctggtgcaggacggtgaggacgctgaccacacggtacgtgctgttgtactgctcctcccgatctttgcaaaccacactacgcacacaagttccaggacagactcacgattaccgcggacgaatccacgagcacagtctacatggagatgagtagcctagagactcgtagaaccgacgacggtccgtagttatttcgtggtgacggaggaggcggggccgaggggccgtcgggtaggtaacggttaggtgttcgtttttagattacgtcgggtggggtaccgaaagggactaagtcggtacctacccgtcctcctacgaccgccctacccaacccgacgggacccctacgttccccggttccccttcccccggtcggacccctaccccctccgtacccgaaagaccgaccctacccggtacggtaccggggaccaaccggcggcccggtcccgtggggccttcgggccgttacgggtaccgaaacggtacctttaccgtacccgaacggttacaacggttaccgaaccgttgggacggtcccgggcgtaacggggaccg

SEQ ID NO: 378644 - DNA, 682 bp, Homo sapiens
  misc_feature: GZ8MTXP02GQGHJ.38.26.C04.1.454.CMB.2.raw
  modified_base (335)..(335): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaactccacgagcacacgtctacagtggagatgagtagcctgagatcgtagacgacgacggccgtgtattctgtgcgaggaggnggggccgaggggctcgggtaggtaacggttaggtcgtcgttttgagttagtcggtgggaccgaaaggggacaagtcgtcctaacccgtctcccgtcgaccgccctcccaaccgaacgggcccctacgtcccggtcccctttcccccgcggtccccaccccctaccgtacccgaagtaccgcccgacccgtccgggtacgggggacccacggaccggtcccggccccgtggggtcccgtcggtccccggttaggtaacccgaacggggtaacccttacccgtttacccgacggtttacgaaccgttcggtaaccgtcggggaccggcccggggtagtacgggaaccgg

SEQ ID NO: 378645 - DNA, 562 bp, Homo sapiens
  misc_feature: GZ8MTXP02GO1FF.38.26.C04.1.454.CMB.2.raw
  modified_base (400)..(400): a, c, t, g, unknown or other
  modified_base (479)..(479): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagaagcctgggtcctcggtgaaggtcccctgcaaggcttctggaggcaccttcagcacctatacttcagctgggtgcgacacggcccctggacaaggcttgagtggatgggaggctcccgtccgatcgttgacaaaccacacctacgcacacattccagcagactacacgataccggcgaacgaactccaacganactaacagtactacagtaggaagatagtaaggtacgacctggtaagatcgtagaaccgacgacggcgttagtatttcgngtacgtcgacgaggacggggccgaggggccgtacgggtagttaaacggtggtgttacgtttgagtacgtcggtacgggtaacg

SEQ ID NO: 378646 - DNA, 535 bp, Homo sapiens
  misc_feature: GZ8MTXP02HP1BW.38.26.C04.1.454.CMB.2.raw
  modified_base (282)..(282): a, c, t, g, unknown or other
  modified_base (417)..(417): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtncgacaggcccctggacaagggcttggagtggatgggaggatcctccgatcttggacaaaccgacacctacgcacacaagtccaggcagactcacgattaccgcggacgaactccacgagcacagtctacatgganatgagtacgcctgagatctgacgacgacggcgtgtattcgtgtgcgaggacggacgggggccgaggggcgtcgggtaggtacggttaaggtgtcgtttgagttacgtcgtagggaccg

SEQ ID NO: 378647 - DNA, 618 bp, Homo sapiens
  misc_feature: GZ8MTXP02I8BU7.38.26.C04.1.454.CMB.2.raw
  modified_base (311)..(311): a, c, t, g, unknown or other
  modified_base (407)..(407): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaacggtcccctgcaaggcttcgtggagcacctcagcacctatacttcagcgtggtgcgacgacggcccctggacaagggcttaggngtggagtggggaggtactcccgtccgattcgttagaccaaacctacaccctacgacacaacacgtaccagcagactacacgataccgacgacgacnccagacacacagtacacagtagagacgtgaagtacgcctagagtattccgagaaccgacggtaaccggtccgttaggttactttcgtcggaccggtaggaagggacgggggacgggggaccgacgggggtcctaacgggggttacggtttaaacggttggggttcgttacgttttaggacgtttaacggtcggggttacggggaaaaccgg

SEQ ID NO: 378648 - DNA, 647 bp, Homo sapiens
  misc_feature: GZ8MTXP02JG7NT.38.26.C04.1.454.CMB.2.raw
  modified_base (284)..(284): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatacttcagctgggtncgacacggcccctaggacaaggcttggagtggagtggggaggactcccgtcccgattccgttaggaccaaaaccacaccctacgccaacaacaacgttaccaggacagactaccgacgtactacccggacggaacgaaactcccgaacggacgaccaacgtacgtacctaccgagtagggaagagttacggaaaggtaacgccgtaggaacgacttcgtacggaacgaccggtaccggtccgttagttacgtttcgtagtcggacggaggaggggaacgggggccgtagggggtccttacgggggtaggttaaacgggttggtggttacgtttttaggacgttagtaccggtaggggaaccgg

SEQ ID NO: 378649 - DNA, 571 bp, Homo sapiens
  misc_feature: GZ8MTXP02IWKOT.38.26.C04.1.454.CMB.2.raw
  modified_base (283)..(283): a, c, t, g, unknown or other
  modified_base (479)..(479): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtncgacacggcccctaggacaagggcttgagtggatgggaggatccgtccgatctttggacaaaccacacctacgacacacaagtccaggacagactcaacgacgttaccgacggaacgaaatcccaacgaagcaacgagtctaacatggaagatgaagtagcctagagatcagaccgacgacggcctagtatttcgngtgcggaaggagggacgggggaccgaggggtctacgggtacggttaacgttaagggtgtacgttttaggacttaagtcggtacggggaaccg

SEQ ID NO: 378650 - DNA, 683 bp, Homo sapiens
  misc_feature: GZ8MTXP02GUIEW.38.26.C04.1.454.CMB.2.raw
  modified_base (279)..(279): a, c, t, g, unknown or other
  modified_base (422)..(422): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctggtcctggtgaaggtccctgcaaggcttctggaggcaccttcagcacctatactttcagctgggtncgacacggcccctggacaggcttgagtggagtggggaggactcccgtccgattccgttaggaccaaaccacaccctacgctacacacgttccaaggcagactcacgtacttacccggcggaacaactcccgaagagcctaacngtactaacgagtgggaagatagaagtacggacccgttaggaaggtacttaccggtacggaaacccgtaaccgacccggggtacccgttagttaacgtttaccgtgggttacggtaccggggaagggtaacggggaccgggggggacccgtaaggggggtcccgttaccgggggttaaggggtttaaaccggggtttaaggggttcggttaccggtttttacggaggtttaacggttcggggtttacgggggtaaacccggg

SEQ ID NO: 378651 - DNA, 571 bp, Homo sapiens
  misc_feature: GZ8MTXP02JBPT2.38.26.C04.1.454.CMB.2.raw
  modified_base (246)..(246): a, c, t, g, unknown or other
  modified_base (280)..(280): a, c, t, g, unknown or other
  modified_base (347)..(347): a, c, t, g, unknown or other
  modified_base (404)..(404): a, c, t, g, unknown or other
  modified_base (421)..(421): a, c, t, g, unknown or other
  modified_base (474)..(474): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttcnggaggcaccttcagcacctatcttcagctgggtncgacaggcccctggacaagggcttggagtggagtggggaggatcccgtcgattcgtttggcaaaccncactcgcacacagtccagccagctacacgacttacgcggacaatccgaacgagacanacgtactacagtagganataggagtacgctagagacttcgagaccgacgacggtccgttagtatttccgngtgacgtaggagggcgggggaccgagggggtcttacggggtaggttaaccggtttggtcgttacgttttggacttacgtcgggtcgggtaaacccgg

SEQ ID NO: 378652 - DNA, 609 bp, Homo sapiens
  misc_feature: GZ8MTXP02HCC7A.38.26.C04.1.454.CMB.2.raw
  modified_base (472)..(472): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctggaggtgaagagctggtcctggtgaacgtccctgcaaggtcttcgtggacggcctaccttcagcacctatacttcgagcgtggtgcgaacgcggccccgtaggaacgaggtcttggagtggagtggggaggtactcccgtccgtattcgttaggaccaaaccacgaacccgtacgaccaacgtaaacgtacgttccgaaggacctacgacctacgacgtacgtaccggacgtaaccaactccgaacgacgactacacgttacacagtaggaanagtgaagtacgtctagtagtactcgacgaccgacgacggtccgttagttaacttcgtagacgtacggaagggtacggacgggtcggagggtccgtaggttaggtaacgtggtctagttgaactgtacggtaggaacg

SEQ ID NO: 378653 - DNA, 593 bp, Homo sapiens
  misc_feature: GZ8MTXP02FRNRZ.38.26.C04.1.454.CMB.2.raw
  modified_base (348)..(348): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggcttcgtggaggcaccttcagcacctatactttcagctgggtgcgacaggcccctggacaaggcttgagtggagtggggaggctccgtccgatcttgacaaaccncactacgcacacacgtccagacagactcacgataccgcgaacataccagacgacacagtcacagtgagatgagtacgacctaggatatacgtagaaccgacgaccgggtcgttaggttctttaccggtgtcggaccggagggacggggtacgggggacccgaagggggtcgttaccggggtaggttaaaccgggttaaggttcggttacgtttaggacgtttagtaccggtacggggtaaaccgg

SEQ ID NO: 378654 - DNA, 548 bp, Homo sapiens
  misc_feature: GZ8MTXP02HY2XZ.38.26.C04.1.454.CMB.2.raw
  modified_base (282)..(282): a, c, t, g, unknown or other
  modified_base (343)..(343): a, c, t, g, unknown or other
  modified_base (378)..(378): a, c, t, g, unknown or other
  modified_base (396)..(396): a, c, t, g, unknown or other
  modified_base (409)..(409): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggcaccttcagcacctatactttcagctgggtncgacacggcccctggacaagggccttgagtggatgggaggatcctccgatcttggcaaacncactacgcacacatccagcagactcacgataccgngacgaatccagacgcacngtactacatgganatagagtagcctgagatctagacgacgacggtccgtgttacttcgtggtcgcggagagggacgggggtcccgaaggggtccgtcgggttaggttaaccggttaaggtacgtcgttttagatacgtcgtcggggaaccgg

SEQ ID NO: 378655 - DNA, 648 bp, Homo sapiens
  misc_feature: GZ8MTXP02IS03Z.38.26.C04.1.454.CMB.2.raw
  modified_base (286)..(286): a, c, t, g, unknown or other
  modified_base (545)..(545): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagcctgggtcctcggtgaacggtcccctgacgaaggcttcgtggaggcaccttcagcacctatacttcagctgggtncgacacggcccctggacaggcttggagtggagtggggaggtactcccgtcccgtattcgttaggaccaaaaccacaccctacgacaacaactaacgttccgaagacacgactaccgaacgacttacccggacggaaccgaaactcccgaaacggaacgccaacacgttacctaaccaagttagggaagtagttaggaagttacggaccttaggagtacgtacgtagaccgaacgacggtcccgttaggtacttttcggngtaggacgaggaggggacgggaccggacggggtcgtacggggttacggttaacggttggttacgttacggtttagacgtttacggtacgggtacgggaaaccg

SEQ ID NO: 378656 - DNA, 672 bp, Homo sapiens
  misc_feature: GZ8MTXP02HWOSP.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagcctgggtcctggtgaaggtcccctgcaaggcttcgtggaggcaccttcagcacctatactttcagctgggtgcgacacggcccctggaccaagggcttggagtggatggggagggtactcccgtaccgattccgtttggaccaaaaccaccaccgtacgaccactaacaagttccccaaggcgagaacctacgaccgtaagttacccggcgaaacgaactcccgaacgacgacacacgtactacagtcggagagtagagttacgaccttagaacgtagtacgtacggaaccggaacgaccgggtaccgtacggttaacgtttccgtaggttacggacggaggggtaacggggaacgggggccggaacgggggtccggtacgggggttacggttaaaccgggttaaggggttcggttaccggtttttacggagtttaacggttcgggtacggggtaaacccggg

SEQ ID NO: 378657 - DNA, 586 bp, Homo sapiens
  misc_feature: GZ8MTXP02GUX96.38.26.C04.1.454.CMB.2.raw
  modified_base (430)..(430): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctggtcctggtgacggtcccctgcaaggcttcgtggagcaccttcagcacctatactttcagcgtgggtgcgacacggcccctggacgaggtcttggagtggagtggggaggctccgtccgtattcgttagccaaacgcacctacgcacacagtccgagcagactacacgtactacgcgaacgactccgaacgacgacacgagtactacgagtaggaanagtagagtcgactagagactcgtacgaccgacgacgggtccgtagttacgttcgtggtacgacgggaggacggggacggggccggagggtcggtacggggttgggttaaacggtttggtcgttacgtttaggaacgttggtccggaggggtaaccg

SEQ ID NO: 378658 - DNA, 715 bp, Homo sapiens
  misc_feature: GZ8MTXP02H76NU.38.26.C04.1.454.CMB.2.raw
  modified_base (207)..(207): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgattctttggcaaaccncactacgcacacaagttccaggacagactcacgattaccgcggacgaatccacgagcacagtctacatggagatgagtagcctagagatctgacgacgacggccgtgttatttctgtgacggtaggagggacggggccgaggggcgtcggggtcggtaacggtttagggtgtcgtttttgagttagtcggtcggggacaagggggtactaagttcggtacctacccggttcctccgtacgtacgcccctacccgaacccgaaaccggggtccccctaacgttcccggtaccccgtttccccccgtacgggtcccctaacccccgttccctacccgaaaacgtccgaccgacccgttcggtaccgggggaccaccggaccggcccggtcccgtcggggtacccgtcggtcccggttacgggtaccgtaaacgggtacctttacccgtacccgtacggtcgttaaccgtcggtaacccgtgggacggccggggttcgtacgggaacccgg

SEQ ID NO: 378659 - DNA, 577 bp, Homo sapiens
  misc_feature: GZ8MTXP02HZ3VW.38.26.C04.1.454.CMB.2.raw
  modified_base (284)..(284): a, c, t, g, unknown or other
  modified_base (423)..(423): a, c, t, g, unknown or other
  modified_base (430)..(430): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagctgggtncgactaggcccctaggacaagggcttggagtggatgggagggatcccgtccgattcgttggaccaaacacacctacgcacacagttccagcagactacgacgtagtaccgacgaacgtacacacgagacacagtaccanagtgganatgaagtgaccgtagagagtctacgacgaccgacggtacgtacttacgttcgagtgtacggagacgggacgggacggacgggtccgtaggggttacggttaacggtaaggtcgttacgtttacgagttacgttcggacgggtaacgg

SEQ ID NO: 378660 - DNA, 558 bp, Homo sapiens
  misc_feature: GZ8MTXP02GI025.38.26.C04.1.454.CMB.2.raw
  modified_base (282)..(282): a, c, t, g, unknown or other
  modified_base (377)..(377): a, c, t, g, unknown or other
  modified_base (387)..(387): a, c, t, g, unknown or other
  modified_base (394)..(394): a, c, t, g, unknown or other
  modified_base (411)..(411): a, c, t, g, unknown or other
  modified_base (413)..(413): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtncgacaggcccctggacaagggcttgagtggatgggagggactcctcccgatctttggcaaaccacacctacgcacacaagttcccaggcagactnacgataccgngacgaanccacgagcacagtcaananagagatagagtagactgagatactagacgacacgacgcgtagtattcgtgtagacggaggacgggacgggggaccgggacggggtcggtcgggttacgggttaacgggttaggttaggttcgtttagtagtacgtcggtacgggg

SEQ ID NO: 378661 - DNA, 627 bp, Homo sapiens
  misc_feature: GZ8MTXP02I3KJ3.38.26.C04.1.454.CMB.2.raw
  modified_base (318)..(318): a, c, t, g, unknown or other
  modified_base (479)..(479): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttcngtgcgagagaggggccaggggctcggtggtaacgttaggtgcgttttgatatcgtggggccaaagggacaagtcggtcaccgtctcctcacgccctacaccgaaacggcccaacgtccggtccttccccctggtccctaaccccgtccctaccaaacgacnccgaaccctcgtcgggggcaccgacggccggacccgtcggggcctcgggccctcgggtaccgtaaacgggaaccttaacccgtttaccgaaccgttacggaaacgtcccggtaaaacgtcgggaacggccgggggcgtcgggaaccgg

SEQ ID NO: 378662 - DNA, 748 bp, Homo sapiens
  misc_feature: GZ8MTXP02HGS91.38.26.C04.1.454.CMB.2.raw
  modified_base (280)..(280): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagcctggtcctcggtgaacggtcccctgcaaggcttcgtggagcaccttcagcactatacttcagtcgtggtncgacacggcccctggacgagggcttggagtggagtggggaggactcccgtcccggattccgttaggaacctaaaaccactaaccccgtacgaccgaactaacgtaacgttcccgaagggacctacggtaacctacgaaccgtaaccttaccggacgggtaaccgaaacgtcccgaacggaacgaccaacgtacgtaccctaagaggttacgggaaagtagtagtaacggtacgtaccgttaggaacgtacgttaccggtacggaaaccggtacccgtaaccggggtccgttaggtttacgttttccggaggttcgggtaacggggaacgggtacgggggtaaacggggggccccggtaaaggggggtccggttaccgggggtaaggttaaaccggtttaaacgggggtttacgggttgtttaccgggttttagtaacggtttaacggttcggggtaaaacccgggggg

SEQ ID NO: 378663 - DNA, 691 bp, Homo sapiens
  misc_feature: GZ8MTXP02HT3LG.38.26.C04.1.454.CMB.2.raw
  modified_base (433)..(433): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtactttctggtcgcgaggaggaggggccgaggggctcgggtggtaaacgtttaggtcgtcttttagattagttccgtgggggacctaaaggggacctaaagtcgggtcaacccgtcctcccncgacgccctacccgaacccgtaacgggcccctaacgttcccgggtcccctttccccccgacggtcccctaacccccgttccttaccccgaaacgccgacccgacccgttcggacgggggcaaccgacggcccggcccccgtgggggcccttcggaccccgttagggtaccaaacgggaaccctttacccgttacccgtaccggtacgtaaccgttaccggaccgttacgggaacggccgggggtccgttacggaccgg

SEQ ID NO: 378664 - DNA, 536 bp, Homo sapiens
  misc_feature: GZ8MTXP02FRXGU.38.26.C04.1.454.CMB.2.raw
  modified_base (345)..(345): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtccctgcaaggcttctggaggcaccttcagcacctatactttcagctgggtgcgacaggcccctggacaagggcttgagtggagtgggaggatccctcccgattcttggcaaaccncacctacgcacacagtccagcagactcacgataccgcggacatccacgagcacagtacacatagagatgagtagcctagagatacgtagacgagtacggccgtagtattctgtgcgagaggacggggccgaggggcgtacggtggtaacggtaaggttcgtacgttttgagttagtcgtcggggtaaccgg

SEQ ID NO: 378665 - DNA, 640 bp, Homo sapiens
  misc_feature: GZ8MTXP02JX4QI.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggaacgaatccacgagcacagtctacatggagatgagtagcctgagatctgacgacacggccgtgtatttctgtgcgagaggaggggccaggggctcggtggtaacgttggtgtcttttgattatcgtggggaccaagggacaagtcggtctacccggtctccgtacacgtcctacccgaccgtaacggccctacgttcccggtcccttcccccgtcggtacccacccccttcccgtacccaaacgacgcccgtaaccgtccggtacgggggccaccggacggccggcccgtgggcccgtcggacccgtcgggtacgtaaacgggtaccttaccgtttaccccgacgtacggtaacgtccggtacgtcggtacggccggggtacgtcggaccg

SEQ ID NO: 378666 - DNA, 566 bp, Homo sapiens
  misc_feature: GZ8MTXP02JHBI5.38.26.C04.1.454.CMB.2.raw
  modified_base (432)..(432): a, c, t, g, unknown or other
  modified_base (506)..(506): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtggtcctcggtgaacggtcccctgcaaggcttcgtggaggcaccttcagcactatacttcagctgggtgcgacacggcccctggacagggcttggaggtggagtggggaggactcccgtccgatcgtttggaccaaaccacaccctacgcacactagtaccagacagactacacgtactaccgacggacaactccgacgacgcacagtcacatcgganatcgaagtacgcaggtacatcgtacgacgacgacggtcctgttacttgtcgtgacgaggagggacggggtacgnggggtcgtacgggtaggttacggtggtcgtcgtttagagtacgtcgggtacgggtaacgg

SEQ ID NO: 378667 - DNA, 611 bp, Homo sapiens
  misc_feature: GZ8MTXP02HDV6M.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccagagcacagtctacatggagatgagtagcctgagatctgacgacacggccgtgtatttctgtgcgagaggaggggccaggggcgtcggtcggtaaacgttggtgtcgttttgattagtcgtggggacaagggacaagtcggtacaccgtctcctcgacgcctacccgacccgaacggcccacgttccggttacccttcccccgtcggcccaccccgtcctaccctaagaccgccgaacccgtcgtcgggggcctaccgacgcccggcccgtgggccgtcgcccgtaggtccgaaacggtacctaccgttccgaacgtacgaacgtcgacgtcggacggcgggaccgtcggacgg

SEQ ID NO: 378668 - DNA, 654 bp, Homo sapiens
  misc_feature: GZ8MTXP02HH2JE.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggcttcgtggaggcaccttcagcactatacttcagcgtgggtgcgacgacggcccctggacaagggcttgagtggagtgggaggactcccgtcccgtagtcgtttacggaccaaaaccgtcaacctaccgacaacacgtaacgttccgaagggtaccaggtaactaccaaccgtaacgttaacccggacgaaaccggaaactacccgaacggaacaccgaacaacgttaccaaactagtaggaacgagttagaacgttagaccgttaggagagttaccgaggaccgaccgtaacggtccgtagtttacgtttaccgtggtgtaccggaggtaacgggcggggaccggacgggggtcgtacggggttaggtaaacgttggtgttcgtttaggattacgtcggtagggaaccgg

SEQ ID NO: 378669 - DNA, 531 bp, Homo sapiens
  misc_feature: GZ8MTXP02FF9JZ.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacacggcccctggacaagggcttggagtggatggggagggatccctccccggattcgtttggctaaaacccgacacctacgcacacaagttccagcagactcacgattacgcgacgaatcacgagcacagcacatggagatgagtagcctgagatctgacgacgacggcgtgtattctgtgcgagaggacgggggcgaggggcgtcggtaggtaacggtggtgtcgtttagatactcgtcgggacg

SEQ ID NO: 378670 - DNA, 743 bp, Homo sapiens
  misc_feature: GZ8MTXP02H5LEH.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaacgttccaggacagactcaacgacttaccgcggaacgaatccgaacgacgcacacgtactacagtggagatgagtagctgagtactcgtagaaccgacgaccggtccgtagttactttcgtggtgacggaaggacggggacggggaccgaggggtcgtacggggtaggttaacggtttaggtgttgtttagagttcgtcggtaggggaccaaaggtacgaaacgtcggtacctacccggttccttcccgtacgacccgtcccctacccgaaaccggaacccgggtacccctagttcccccggttaccccctttcccccgacgtaccccctaacccccgttacctaaccccggaaagtaacccgcccgtaacccgttccggggacgggggacccaaacccggacggggccccggtaccccggtggggtccccaacggtcccggtacggggtaaccaaaccgggttcctacccgttacccgagtcgtaacgtaccgaacgtcggaccgggtccggtagacggccgg

SEQ ID NO: 378671 - DNA, 789 bp, Homo sapiens
  misc_feature: GZ8MTXP02II5T6.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctagagtatctagacgacgacggtccgtagtatttctgtgacggaggtaggcgggggaccaggggcgttcgggtcggttaaacggttaggtgtcgttttagagttacgtcggtgggggacccgaaagggggaacctaaggttcgggtacctaacccggtccttacccgccgtacgccccgttacccgaacccgtaaaccgggggtcccccaacgtttcccgggttcccccgtttacccccccgtacggggtaccccctaaccccccggttaccccgttaaccccgaaaccggaccgtacccgtaaacccccgttccggggtaccggggggaccctaaccggaaccggggtccccggtcccccgggtagggggtccccttaaccgggtccccgttacggggtaccgaaaacgggttacccttacccgttacccgtaacggtcggtaaccgttaccggaccgttacgggaaccgggtccggggtaccggtacggaaacccgggg

SEQ ID NO: 378672 - DNA, 625 bp, Homo sapiens
  misc_feature: GZ8MTXP02H9YMF.38.26.C04.1.454.CMB.2.raw
  modified_base (206)..(206): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccncactacgcacacaagttccaggacagactcacgattaccgcggacgaatccacgagcacagtctacatggagatgagtagcctgagatctgacgacacggccgtgtatttctgtgcgagaggaggggccaggggctcgggtggtaacgttaggtgcttttgattatcgtggggcaaaggggacaagtggcaccgtctcctcacgcctaccaccgaaacgggcccacgtccggtcccttcccccgtcggccctaccccgttccctacccgaacgacgaccctacccgtccgtcgggggacaccgacggccggcccgtcggggtcctcggcccgttgggtcgaaaacgggtaccttaccgttacccgtaacggttcgaacgttaccgaacgttcggacggccggggtacgtcgggaaccgg

SEQ ID NO: 378673 - DNA, 641 bp, Homo sapiens
  misc_feature: GZ8MTXP02GN4UY.38.26.C04.1.454.CMB.2.raw
  modified_base (285)..(285): a, c, t, g, unknown or other
  modified_base (377)..(377): a, c, t, g, unknown or other
  modified_base (438)..(438): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagccactatactttcagctgggtncgacacggcccctggacaaggcttgagtggagtgggaggactcccgtccgattcgttgaccaaaccacacctacgcacactaagtccagacngactcgaacgtactaccgcgacgaactccgaacgacgactacgagttacacgtataggaanagtagaagttacgaccgttgaagtactacggaacgaacccggacgtacccggtaccgttagttaacgtttcggcgaccggacggacgggaaggggaccggggtacccggaagggggtcccgtacggggttaaccggttaacgggtttaagggttccgttacgttttaggaacgtttacggtccggttacggggtaaaacccgg

SEQ ID NO: 378674 - DNA, 636 bp, Homo sapiens
  misc_feature: GZ8MTXP02FSTH2.38.26.C04.1.454.CMB.2.raw
  modified_base (480)..(480): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctcggtgaacggtcccctgcgaaggtcttcgtggacggcaccttcagcacctatactttcagtctgggtgcgacaggcccctaggacgaaggctgagtggagtggggaggatcccgtccgattcgtttcggaccaaaccacgacctacgacacaacaacgttaccaaggtaccaagacctacgaccgtacgttacccggacggaacaactcccgaacgacgacactagtacacagtaggagagtcgaagtcgactggangtacgtagaaccgacgaccggtcgttagttacgtttcgtggtacgacggagggacggggtacgggggacccgaagggggtcgtacggggttacgggttaaacggttaaggttcggttacgttttaggactttacggtcgggtacggggtaaaccgg

SEQ ID NO: 378675 - DNA, 609 bp, Homo sapiens
  misc_feature: GZ8MTXP02HUSM2.38.26.C04.1.454.CMB.2.raw
  modified_base (297)..(297): a, c, t, g, unknown or other
  modified_base (414)..(414): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatcgngacgacacggccgtgtatttctggtgcgaggaggacggggccgaggggcgtcgggtaggtaacgttaggtgtcttttgattagtcgtggggacaagggacaagtgtcaccgtctccncacgccctccaccgaacggcccacgtccggtcccttcccccgtgcccaccccttcccgtaccgaacgtacgcctaacccgtggcggggcaaccgcggcccggtcccgtggccttcggcccgttgggaccaacgggaccttaccgtcccgaacggtcgtaacgtccgaacgtcggaggccgggcgtaggaacccgg

SEQ ID NO: 378676 - DNA, 551 bp, Homo sapiens
  misc_feature: GZ8MTXP02HTNQC.38.26.C04.1.454.CMB.2.raw
  modified_base (281)..(281): a, c, t, g, unknown or other
  modified_base (462)..(462): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctggtncgacacggccctggacaaggcttgagtggagtggggaggactcctccgatcgtttgacaaaccgacacctacgcacacagttaccaggcagactcacgactaccgcgaacgaactccagacgacacgagtacacagaggagatgaagtcgactgagatacagacgacgacgtcgtacgttnttacgtgtgacggagaggacgggcgacggggcgtcgggtaggttaccggtaaggtcgtacgttttgagtacgtcggttacggggaaccg

SEQ ID NO: 378677 - DNA, 612 bp, Homo sapiens
  misc_feature: GZ8MTXP02HLTSY.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagcctggtcctcggtgaaggtcccctgcaaggcttcgtggaggcaccttcagcacctatacttcagctgggtgcgacacggcccctggacaagggcttggagtggagtgggaggactcccgtccggattcgttggaccaaaccacacctacgcacacagtccagcagactacacgacttaccggcggtacaactccgaacgacgcaacagtacctaacagtaggaagtagtaggaagtacgaccgtagtaagtatacgtagaaccgaccgaccggtccgttagttacttcgtagtacggaccggaggacggggacgggggaccgtacgggggtacgtacggggttaggttaaacggtttgggtcgttacgttttagagtttacgtacgggttacgggaaaccggg

SEQ ID NO: 378678 - DNA, 617 bp, Homo sapiens
  misc_feature: GZ8MTXP02F4A2U.38.26.C04.1.454.CMB.2.raw
  modified_base (261)..(261): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggatcctctttgtggtggcagcagctacaggtgtccagtcccaggtgcagttggtgcagtcgtggggctgaggtgaagaagccgtgggtcctggtgaacggtcccctgcaaggcttctggaggcaccttnagcactatacttcagctggtgcgacacggcccctggacaagggcttggaggtggagtggggaggactcccgtccggtattcgttaggacctaaaccaccactacgacacacaacgttccaggacagactcacgataccgacgacgaactccgacgacgcaacacgtcctaacgagtacggaagagttacggaagtacgaccgtagagtacttacgacgacggtacgaccgggtaccgttagttacgtttcgtgtacgggcggtaaggacggggacgggggcgtacgggggtaccggtcggggtaacgggttaacggttagggtgttacgtttagacgttacgtcggttaacggggg

SEQ ID NO: 378679 - DNA, 626 bp, Homo sapiens
  misc_feature: GZ8MTXP02H6K89.38.26.C04.1.454.CMB.2.raw
  modified_base (246)..(246): a, c, t, g, unknown or other
  modified_base (283)..(283): a, c, t, g, unknown or other
  modified_base (311)..(311): a, c, t, g, unknown or other
  modified_base (453)..(453): a, c, t, g, unknown or other
  modified_base (465)..(465): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaacgtccctgcaaggcttcgnggagcaccttcagcaaccttatctttcagcgtgggtncgacgacggccctggacaagggtcttgnggtggagtggggaggactccgtccgattcgttagaccaaaccacaccacgacacactaagtcgacgacacgtactaccgacgtacttaccggacggaacgaacctaccacgaacgacgaacacgtacctaacgacgtagganagtagaggtacncgtagagtactacgtaggacgacgacggtccggttattacgtttgtacgtcggacggaagggtacgggggacgggtcccgggaagggggtccgtacgggggttaggttaaccggtttggtacgttcgtttacggtagtacggttcggtacggggtaaccgg

SEQ ID NO: 378680 - DNA, 672 bp, Homo sapiens
  misc_feature: GZ8MTXP02IB3J4.38.26.C04.1.454.CMB.2.raw
  modified_base (245)..(245): a, c, t, g, unknown or other
  modified_base (408)..(408): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtggtctcggtgaacgtccctgcaggcttcgnggacgcacttcagcactatacttcagcgtggtgcgacacggcccctaggacagggctttggaggtggagtgggagggactccgtccgtatgttacggacaaaccgacacctacgcacacaacgttccgagacacgactcacgtacgtaccgacgaccgtaacncccgaagacgacacgacgttcaacgagtggaacgtagttagaaacggtgtacccgttaggaccgttaagttaccgaccgaacggaccgtaaccggtccggtttattaccgtttgttacggaggaccgaaaggggttcggggaccgggtacccggggagggttacccggttacggggttaaggtttaaccgggtttaacgggtttggttaccgtttttacgggaacccgttttaagggttccggtttaacgggggtaaaacccgg

SEQ ID NO: 378681 - DNA, 614 bp, Homo sapiens
  misc_feature: GZ8MTXP02FKWD1.38.26.C04.1.454.CMB.2.raw
  modified_base (415)..(415): a, c, t, g, unknown or other
  modified_base (438)..(438): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctcggtgaacggtcccctgcaaggtcttcgtggagcaccttcagcacctatactttcagctgggtcgcgacacggcccctaggacaaggtcttaggaggtggagtggggaggactcccgtccgattcgttacgacaaaccacaccgtacgacacactaacgtccagacagactacgacgactacgacgacaacncacgagacacagtcacagtaganagtagagacgacgtagagtactacgagaaccgacgtacggtcgttagttacgttgtggtcgacggaaggacggggaccgggggtacggtacggggtccggttacggggttaacgggttaaacggttggtacgtttacggtttaggaacgtttacggtacgggttacgggaaaccgg

SEQ ID NO: 378682 - DNA, 744 bp, Homo sapiens
  misc_feature: GZ8MTXP02JNDZT.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatacttcagctgggtcgcgacacggcccctggacaagggcttggagtggagtggggaggactcccgtcccgattccgtttcggaccaaaacccgacaaccccgtacgaccaacaaccgtaaacggttacccgaagggtaccaaacggaaccttaccgaaccgtaaccgttaacccggacgggaaaccgtaaaactcccgaaacggaacgtaccaaccgtaagtacctaaccgagttagggaaagtagttacggaacggtacgtacctagggtactaacgttccgtacggaaccgaaccgtacccggggtaccgttacgtttaagtttaccgtgggttacggaaccggtaggggaaccgggggaaccgggggtcccggaaacgggggtccgttaccgggggttaagggttaaaaccgggttcgggttagtttccggtttaggaaaccgtttaggtccgggtacggggtaaacccggg

SEQ ID NO: 378683 - DNA, 580 bp, Homo sapiens
  misc_feature: GZ8MTXP02JW5NI.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacaggcccctggacaaggcttgagtggatgggaggatcctccgatcgtttggccaaaccgacaccctacgcacacaagttccaggcagactcacgattaccgcgacgaatcccacgagacacagtctacatggagatgagtagcctgagatcgtagaacgacgacggccgttagtactttcgtgcgcggaggacgggacgggggccgacgggggtccgtacgggggttacgggttaaaccggtttaagggttacgtcgtttttacggagttacggttcggtacgggggtaacccgg

SEQ ID NO: 378684 - DNA, 635 bp, Homo sapiens
  misc_feature: GZ8MTXP02JX72X.38.26.C04.1.454.CMB.2.raw
  modified_base (293)..(293): a, c, t, g, unknown or other
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagntctgacgacacggccgtgtatttcngtgcgagaggaggggccaggggctcggtaggtacgttaggtgtcgtttgattgtcggtacgggggaccgaaagggggacaaagttcggtacgtacccggtccttacccgtccgacgccctacccaacccgaacggaccccgaccttcccggtcccttcccccgtcggtccccgaaccccttccctacccgaacgacgccgtacccgtcggtcggggcgacccgacggccggcccgtcgggctcggtccgtcggtaccaacgggtaccttaccgtccgtaacgtgcgtacgccgtacggacggcggggccgtaggacg

SEQ ID NO: 378685 - DNA, 598 bp, Homo sapiens
  misc_feature: GZ8MTXP02GE7JH.38.26.C04.1.454.CMB.2.raw
  modified_base (414)..(414): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagcctgggtcctcggtgaaggtcccctgcaaggcttctggaggcaccttcagcacctatactttcagctgggtgcgacacggcccctaggacaagggcttggagtggagtggggaggtatcccgtccggattcgtttggaccaaaaccgacaccgtaccgcaacacgtaagtccaggacacgactacgacgataccgacgacgtaanccgacgagcaacagtcaacagtagagatggaagtagcctgagtatcgtaggaaccgacgacgggtccttaggttactttcgtggtcgacggaggacgggacgggggcccgagggggtccgtacggggttggtaacggtttaagggtcgtacggttttgagtttacgtacggtcggggtaaccgg

SEQ ID NO: 378686 - DNA, 715 bp, Homo sapiens
  misc_feature: GZ8MTXP02G53EC.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagcctggtcctggtgaacggtcccctgcaaggcttcgtggaggcaccttcagcacctatactttcagcgtgggtcgcgacacggcccctggacgaaggtcttggaggtggagtggggaggactcccgtaccgtattcgttacggaccaaacctacaccctacgacacgactaacgttccaggacagtacctacgaaccgtacgttaacccggcggtaaacccgaaactacccgacgaacgaccgtaaccgaacgttactaaaccgaggtacggaagtacgtagggtaaacgtacgtaccgtaggaagtacgttaccggtagaaccggaccgtaaccgggttccggttagtttacgtttaccgtgggtcggtaaccgggtagggacggggacgggggtaccggtaagggggtccggtttacgggggtacgggtttaaaccggggttggttccggtttacgttttagggtaaacgtttcgggttaccgggttacggggtaaaacccgggg

SEQ ID NO: 378687 - DNA, 650 bp, Homo sapiens
  misc_feature: GZ8MTXP02JEA0Y.38.26.C04.1.454.CMB.2.raw
  modified_base (467)..(467): a, c, t, g, unknown or other
  modified_base (537)..(537): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagcctgggtcctcggtgaacggtcccctgcaaggtcttcgtggacggcaccttcagcacctatacttcagcgtgggtgcgacacggcccctaggacgaagggtcttagaggtggagtggggagggtactcccgtccgattcgtttggaccaaaccgctaaccctaccgcaaccactaacgttaccaggaccagactacgaacgacgttaccgacggacgaaactccgaacgagacaacagtactaccagtacgganagtcgaagttgaccgttaggaagtacttacgacgaaccgtacgaccgggtccgttagtaacgttttcggnggtacgacggtacgggaggggaccggggtacggtacggggtcgttacggggtacggttaacggttgggttacgtttacgtttaggaacgtttcggtacggggtacggtaacgg

SEQ ID NO: 378688 - DNA, 636 bp, Homo sapiens
  misc_feature: GZ8MTXP02JWC47.38.26.C04.1.454.CMB.2.raw
  modified_base (294)..(294): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgaganctttttgacgacgaccggccgtgtatttctgtgcgaggaggaggggcgaggggcgtcggtacggtaacggttaggtgtcgtttgattagtcggtcggggacgaaacgggactaagtggtaccgaccgtcctcctcgacgcctacccaccgaacggcccacgtccggtcccttcccccgtccggccctacccctccctaccctaacgacgccgaccgtcgtcggggaccgacgacggccggcccgtcgggcgtcgtccgtcggtaccgaaaccggtaccgttaccgttacccgtacggtacgtaacgtccggtacgtacggacggcgggtcgtacggaaccgg

SEQ ID NO: 378689 - DNA, 624 bp, Homo sapiens
  misc_feature: GZ8MTXP02GAOQV.38.26.C04.1.454.CMB.2.raw
  modified_base (284)..(284): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtcctcggtgaacggtcccctgacaaggcttcgtggagcaccttcagcactatacttcagcgtgggncgacaggcccctggacaaggcttgagtggagtgggaggactcccgtccgattcttcggaccaaaccacgacctaccgacacacaacgttccaggacacgactcgaacgtacgtaccgacggaccgaaactccacgagacaaccagtacaactagaggaacgagagtaaggtacgaccgttacggaagtacttacgacgacgacccgaacggtccgttaggttacttcgtaggtacggtacggaagggacggacgggggacgacgggggtccgtacgggttagggttaacggttaaggttacggttcgtttaggacttacggtccgggtacgggtaaccgg

SEQ ID NO: 378690 - DNA, 740 bp, Homo sapiens
  misc_feature: GZ8MTXP02H0MPL.38.26.C04.1.454.CMB.2.raw
  modified_base (136)..(136): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctntttgtggtggcagcagctacaggtgtccagtcccaggtgcagttggtgcagtctggggctggaggtgaagagcctgggtcctggtgaacggtccctgcgaaggtcttcgtggacggcacctcttacgcctacctatactttcagtcgtgggtcgcgacgacggccccgtaggaacgaaggcttggaggtggagtggggaggactccgtacccggtattcgtttacgaccaaaccaccaacgtaccgcctaacaccgtaagtccgaaggacaacgctaccgaaacgtacgtacccgacgaacgtaactccgaacgacgaccaacgacgtacacgagttacggaagagtaacgtagtacgtacccgtaggtaacgtacgtttcgaacgtaaccgggtaaccgtacccgggtaccgtttagtttaacgtttccggtaggttacggaaccgggtaaggggttaaacgggggaccgggggtaaccgggttaccgggggtacggtttacgggggttacgggtttaaaccgggttaggggtttacgtttaacggttttaggaaacggtttccggtaacggtaccgggggtaacgtaaacgggggttaaccg

SEQ ID NO: 378691 - DNA, 635 bp, Homo sapiens
  misc_feature: GZ8MTXP02IF87Y.38.26.C04.1.454.CMB.2.raw
  modified_base (333)..(333): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaggtccctgcaaggcttctggaggcaccttcagcacctatacttcagctgggtgcgacgacggcccctggacgaagggcttggagtggagtggggaggatcccgtccgngttcgtttaggcctaaaccgacaccgtacgaccacactaacgttccaacgggtacacgaactaccgaacgtacttaacccggacggtaaccgaactccgaacgagcaacgacgtactacagtacgagagtgagtagccgtgagatcgtagaccgacacgacggtccgttaggttactttacgtagttcggaggacggaggggaccgggggacggtacgggggtacggttcggggttacggggttaagggtttaacgggttgttacggtttttaggtacgtttaacgttcggggtaacggggg

SEQ ID NO: 378692 - DNA, 598 bp, Homo sapiens
  misc_feature: GZ8MTXP02GSBLL.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcgacgaatccacgagcacagtctacatggagatgagtagcctgagatctgacgacacggccgtgtatttctgtgcgagaggaggggccaggggctcggtcggtaacgttaggtgtctttttgacttagtcgtggggccaaagggacaagtggtcactctctcagcctccacacggcccatccggtccttccccgtgccctacccgtcctaccaagacgccaccctcgtcggggcaccgacgccggcccgtggcctcgcccgtggtacccgaaacgggtaccttaacccgttccctaaccggttcgtaacgaccgtaaccgttcggacggaccggggaccgttcggggaaccg

SEQ ID NO: 378693 - DNA, 811 bp, Homo sapiens
  misc_feature: GZ8MTXP02FL71R.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatcccacgagcacagtctacatggagatgagtagcctgagatctggacgacgcggccgtgttatttctgtcgcggaggagggacgggggaccgagggggccttacggggtacggttaacggtttaggtgttacgtttttggaattacgttcgggtacgggggaccgtaaagggggtaacctaaaggttcgggtacccgtaacccgtttaccgtcccgtttaccgacggtcccccttacccgaaacccgtaacccggggaccccttaacggttccccgggttccccttccccccggttcgggtaccccctaccccccgttaccgttacccccgaaaggtacccgtacccgtaaacccggttccgggttaaccggggggcccaacccggtaacgggccccggggtcccccggttcgggggtcccgttacgggtcccccgttacggggtttacccgaaaacggggttaacccttaacccgtttacccggtaacgttaccggaacgtttaaccccggaacggttcggggtaacgggtcccggggtcggtaccgggaaaccgg

SEQ ID NO: 378694 - DNA, 555 bp, Homo sapiens
  misc_feature: GZ8MTXP02IWPIR.38.26.C04.1.454.CMB.2.raw
  modified_base (417)..(417): a, c, t, g, unknown or other
  modified_base (426)..(426): a, c, t, g, unknown or other
  modified_base (439)..(439): a, c, t, g, unknown or other
  modified_base (460)..(460): a, c, t, g, unknown or other
  modified_base (465)..(465): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatacttcagctgggtgcgacaggcccctggacaagggcttgagtggatgggagggatcccgtccgatcttggcaaacacacctacgcacacaagttccaggcagactcacgattaccgcggacgaatccacgagcaacagtctacatgganaatgagtanccgtagagattcngacgacacggccgtaagtttnttcgngtgacggaggacgggacgggggacgacggggtcgtacgggtacggttaacggttaaggtcgttcgtttacgagtacgtcggtacgggacg

SEQ ID NO: 378695 - DNA, 758 bp, Homo sapiens
  misc_feature: GZ8MTXP02HYDP3.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaacgccgtgggtcctcgggtgaacggtcccctgcaagggcttcgtggaggcaccttcagcacctatctttcagcgtggtgcgacgacggcccctggacgaagggtcttggaggtggagtggggaacgggtactcccgtccgtagttcgtttacggaacctaaaccgaccgtacccgtaccgacctaaccgaaccgtaacgttacccgaaagggacctaacggtaacctaccgtaaccgtaaaccgttaccccggaccgggtaaaccgaaaccgttacccgaaacggtacgaccaaccgtaacggtaccttaacgagttagggaacgtacgttaggaaccgttagacccgttaaggaaccgtacgttaccgtaggaaccgaccgtaaccggggttacccgtttgtttaaacgtttcgcggttaccgggacggtaacggggacggggaaccgggggtccggaacgggggttccgttacgggggttaacggttaaccgggtttggtacgttccgttttaggaactttacggtcgggttacggggaaacccg

SEQ ID NO: 378696 - DNA, 541 bp, Homo sapiens
  misc_feature: GZ8MTXP02JH3W5.38.26.C04.1.454.CMB.2.raw
  modified_base (423)..(423): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatacttcagctgggtgcgacaggcccctggacaagggcttggagtggatggggaggatcccgtccgatcgttggcaaaccacacctacgcacacaagtccaggcagactcacgattaccgcgacgaaactccaacgagacacagtctacatcgganatgagtgcctgagatcgtagacgacgacggtccgtgttacttcgtgtgcgaggaggacgggggtccaggggcgtacgggtaggtaacggtggtgtcgtttgatagtcgtagggaaccg

SEQ ID NO: 378697 - DNA, 594 bp, Homo sapiens
  misc_feature: GZ8MTXP02HBKPC.38.26.C04.1.454.CMB.2.raw
  modified_base (359)..(359): a, c, t, g, unknown or other
  modified_base (418)..(418): a, c, t, g, unknown or other
  modified_base (448)..(448): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaacggtcccctgacaaggtcttcgtgggaggcacttcagcacctatacttcagcgtgggtgcgacacggcccctaggaccgaaggcttaggagtggagtggggaggactcccgtccgattcttacggacaaaccncaccctacgacacaactagtccaaggacagtactcaacgtactaccgacgtacgaaacnccgaagacgacactagtactacgatagganagtcgaagtagctagagatcgacgacgagaccggtcgtgttattcgtagagtcggaggtcggggacggggacgacgggggtcctacggggttaggtaaacggttcggtagtaccgtttaggaactcgtaccggtaggggaaaccgg

SEQ ID NO: 378698 - DNA, 643 bp, Homo sapiens
  misc_feature: GZ8MTXP02I1Y6P.38.26.C04.1.454.CMB.2.raw
  modified_base (279)..(279): a, c, t, g, unknown or other
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtcccagtcccaggtgcagttggtgcagtctggggctgaggtgaagaagcctgggtcctcggtgaaggtcccctgcaaggcttctggaggcaccttcagcacctatacttcagctggtncgacacggcccctggaccaagggcttggagtggagtggggaggatccgtccgattccgtttggaccaaaccacactacgccacacagtccagaccagctcacgtactaccgcgaacgactccgaacgagaccacagtcctaacgatacggaagatggaacgttacgcctaggaagccgtacgtacggaccggaaccgccgggtaccgttagttacgtttcgtaggttcggacggaaggacggggacgggggcccggtaagggggtccgttacgggggttaacgggttaaaccggtttaggggttcgttaacggttttaggtaacgtttacggtccggtacgggggtaaccgaaaggggtaaccg

SEQ ID NO: 378699 - DNA, 733 bp, Homo sapiens
  misc_feature: GZ8MTXP02I1GUC.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaagtccctgcaaggcttcgtggagcaccttcagcacctatacttcagtcgtgggtgcgacacggcccctaggacaagggcttagaggtggagtggggaggtactcccgtcccgattcgttacggacctaaaaccgactacccgtaccgccaacaacgtaacgtacccgaaggaccacgaaccttacgaaaccgtacttaaacccggaccgggtaacgtaaactaccccgaacggacgaccaaacgtacggtaccttaaccgaagttacgggaagagtacggtaaacggtaacgtacccgtaacggaagtacttacggacgtaaaccgaccggtaacgggtcccggttaaagttaccgttttcggtaggtacggtacggtaacgggtacgggggaaaccgggggtccggaaacgggggtccggttacggggttaacggggttaaaaccggtttggggacgtttacgttttacggaagttaccgggtacggttacgggggtaaaacccggg

SEQ ID NO: 378700 - DNA, 681 bp, Homo sapiens
  misc_feature: GZ8MTXP02F4871.38.26.C04.1.454.CMB.2.raw
  modified_base (361)..(361): a, c, t, g, unknown or other
  modified_base (484)..(484): a, c, t, g, unknown or other
tcagtcgatcacgtcacgaccggtgctcgatttagtctagcgactttgggtttggggatcacataacaaccacattccctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctggtgaacggtcccctgcaaggcttcgtggaggcaccttcagccacctatactttcagtctgggtgcgacacggccccctggacgaaggcttggagtggagtgggaggactccctccgagttcttcggacctaaaaccncgaaccctacgccaactaacctaacgttccaacggacacgtacctaccgaccgtaacttaaccgggcggaaaccgtaaacacccgaacgaacgacccaactacgtacctacgaagtagggaanagtagtaaggttacgccgtagagacttacgaggaccgacgtacggtccgttagttactttcgtaggtcggtagacggggaggggacgggggaccggtacggggtcccgtttacggggtaacggggtttaaaccgggttaagggttagtttaccggttttaggtacgttacggtcggggttacggggtaaacccgggg

SEQ ID NO: 378701 - DNA, 628 bp, Homo sapiens
  misc_feature: GZ8MTXP02FITK1.38.26.C04.1.454.CMB.2.raw
  modified_base (262)..(262): a, c, t, g, unknown or other
  modified_base (277)..(277): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggccaccttnagcacctatactttnagcgtgggtcgcgacacggcccctggacaagggcttggaggtggagtggggagggactccccgtcccgagttccgtttaggaccaaaacctacaacccgtaccgaccaaccaacgtaaacgttaccccgaagggaccaaggacctcgaacgtacgttaccggacggaacgaacgtacccgaccggagaccaacgacgtacctaacgacgtaggagtacgtacgagtacgccgtagagactcgtagaccgacgcggtccgtgttacttcgtgcgtaggaggaggacggggcgacggggtcgtcgggtaggttaacggttggtcgtatttcggattacgtcggtcgggaaccg

SEQ ID NO: 378702 - DNA, 605 bp, Homo sapiens
  misc_feature: GZ8MTXP02IZ7K1.38.26.C04.1.454.CMB.2.raw
  modified_base (348)..(348): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaacggtcccctgcaaggcttcgtggaggcaccttcagcacctatacttcagctgggtgcgacacggcccctggacaggcttgagtggagtgggaggactcccgtccgattcgttggacaaaccncacctacgcacactaacgtccaggcagactcgacgacgttaccggcgtaacaactccaacgacgacaacacgtactaccagtcggaagatgtaagtacgaccgtagagtacttcgagaaccgacgtaccggtccgttagttagtttccgtggtacgacggagggacgggacgggggtaccgacgggggtcgtacgggttaggttaaacggttgggttacgttcgttttagacgtttacggtcggtacgggtaaccgg

SEQ ID NO: 378703 - DNA, 669 bp, Homo sapiens
  misc_feature: GZ8MTXP02HYSBP.38.26.C04.1.454.CMB.2.raw
  modified_base (285)..(285): a, c, t, g, unknown or other
  modified_base (290)..(290): a, c, t, g, unknown or other
  modified_base (360)..(360): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagaagcctgggtcctcggtgaacggtcccctgcaaggcttcgtggaggcaccttcagcacctatacttcagctgggtncgacncggcccctggacaagggcttaggagtggagtggggaggtactcccgtccgtattcgttaggaccaaaccnctaccctacgaccaacaactaagttccaaggacacgaactcgaaccgtattacccggacgaaacgaaactccgaaccgagaccaacgaacgttactaaccgagttaggaagtagtggtaaagtcgtaccgtaggaagtactcgtacgaacgaccgaccgggtccgttagttaacgttttccgaggttacggaccggtaagggacgggggtaaccgggggccgtaacgggggtccgttacggggttacgggttaaaccggttaagggtcgttacgttttaggaacgtttacggtcggtacgggggaaccg

SEQ ID NO: 378704 - DNA, 646 bp, Homo sapiens
  misc_feature: GZ8MTXP02GG4DQ.38.26.C04.1.454.CMB.2.raw
  modified_base (207)..(207): a, c, t, g, unknown or other
  modified_base (304)..(304): a, c, t, g, unknown or other
  modified_base (640)..(640): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcacgccagtcctggtgcaggacggtgaggacgctgaccacacggtacgtgctgttgtactgctcctccgattctttggcaaaccncactacgcacacaagttccaggacagactcacgacttaccgcggacgaatccacgagcacagtctacagtcggagatgagtacgccgtagagactcngaacgacgacggcgttagtactttcgtggtgacgtaggagggacggggccgaggggtccgttcggggtacggttaaacgttggtcgttcgttttggacttagtcgggtacggggaccgaaaggggactaagtcggtcaccgttcacctacgacgtcctaccaccgaacggccctagtcccggtcccttcccccgggtacccctacccctcgtacccgaaagccgacctaccgtccggacggggccacgcggcccggcccgtggccctacggccgttaggaccgaaacggtcccttaccgtccgaacgtgaaccgtacgacgtaggacggtccggancggacg

SEQ ID NO: 378705 - DNA, 568 bp, Homo sapiens
  misc_feature: GZ8MTXP02FK6HS.38.26.C04.1.454.CMB.2.raw
  modified_base (278)..(278): a, c, t, g, unknown or other
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatgganatgagtagcctgagatctgacgacacggccgtgtatttcngtgcgagagaggggccaggggctcggtggtaacgttaggtgtctttgattatcgtggggccaaagggacaatggtcaccgtctcctcagcctaccacccgacgggccccagttccggtccttccccctggcccacccctcctccaagcgccacctccggtcggggacacgacggccggcccgtgggcctcgcccgttggcgtaaacgctacttccgacgtcgaagtcgactcggagcgggcgtcggacgg

SEQ ID NO: 378706 - DNA, 646 bp, Homo sapiens
  misc_feature: GZ8MTXP02JGAZL.38.26.C04.1.454.CMB.2.raw
  modified_base (250)..(250): a, c, t, g, unknown or other
  modified_base (286)..(286): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctggtgaacggtcccctgcaaggcttcgnggaggcacttcagctactatacttcagtctgggtcncgaccgacggcccctaggacgaagggtcttaggagtgggacgtggggacggtactcccgtaccgtattcgtttcggaacctaaaccacacccgtaccgactaaccactaacgtaccgaagaccacgtaactacgaaccgacgttacccggacggtaacaactaccgaacggacacgaactacgttactacgagtggaacgagttagaagttacgaccttaggacgtactacggtacgaaccgaacgtaccgtaccgttagttacgtttacgtaggtcgacggaggacgggacggggtcgacggggtccgttacgggtaggtaaggttgtcgttacgtttgatacggtcggacggtaacgg

SEQ ID NO: 378707 - DNA, 829 bp, Homo sapiens
  misc_feature: GZ8MTXP02JEO6J.38.26.C04.1.454.CMB.2.raw
  modified_base (279)..(279): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagacctcacgattaccgcgaacgaatccagagcacagtactacatgganatgagtacgcctgagatctgacgtacacggtccgtagttatttcgtgtcggacggaggacgggacgggggccgaggggtcgttcggggtacgggttaaacgttgggtcgttactttttggacgttagtcgggttacgggggaaccgtaaagggggacctaagttcgggtacctacccggttccttacccgtacgaccgacccgttaacccggaacccgaaaccggggaccccctacggtttcccccggggtttccccttaacccccccggttcggggaaccccctaccccccggtttaccctaaccccggtaaaccgtaccgggacccccttaaaccccgggtttcccgggtacccggggggaccctaaaacccggggtacccgggacccggggaacccccgggtttgggggccctttaaccccgggccggttttaccggggtacccgaaaaaccggggtacctttttccccggaccggtaaccggtttacgaaccgttccggaaacggttcgggaaccgggttacggggtacccgggtacgggaaccgg

SEQ ID NO: 378708 - DNA, 640 bp, Homo sapiens
  misc_feature: GZ8MTXP02JK8RT.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagaggaggggcaggggctcggtggtaacgttaggtgtcgtttgatatcgtggggaccaagggacaagtcggtacacccgtctccgtcacgcctccgaacccgacggtccccagtccggtacccttcccccgtggacccgtacccccttcccgtacccaaacgaccgccgtaaccccgtcggtaccgggggaccaaccggacggcccggtcccgtagggaccctcggacccgttgggtacccgaaacgggtacctaccgtttacccgacggttacgaacgttacgaccgttcggaacggccggtcggtacggaaccgg

SEQ ID NO: 378709 - DNA, 719 bp, Homo sapiens
  misc_feature: GZ8MTXP02GP2KP.38.26.C04.1.454.CMB.2.raw
  modified_base (282)..(282): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagaagctgggtcctcggtgaaggtcccctgcaaggcttcgtggaggcaccttcagcacctatacttcagcgtgggtncgacgcggccccgtggacgaaggcttggagtggagtggggaggactcccgtccgattcgttgaccaaaccacacccgtacgacacaacgtaacgttaccgaacggacacgacctacgaaccgtacgttaaccggacgaaaccgtaaactacccgaacggacgaccgaaactaacgttacctaaccgagttacggaagtacgtaggaaacggtacgtaccgtaggtaagtacgttaccgacggaaaccgtaccgtaccgggttacccgttaggtttaacgtttccggttaggtacggtaacgggagggtaacgggggaccggggggtaccgacgggggttaccggttacgggggttaacgggtttaaaaccgggtttggggttcggttaacggtttttacggtaagtttaccggtacgggttacgggggtaaaccggg

SEQ ID NO: 378710 - DNA, 715 bp, Homo sapiens
  misc_feature: GZ8MTXP02G55KJ.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggacaaaccacactacgcacacaagttccaggacagactcacgataccgcggacgaactccacgagcacagtctacagtggagatgagtagcctagagatctagacgacgacggtccgtgttactttcgtggtgacggaggaggggacgggggccgaggggtcgttcggggtacgggttaacggtttaggtcgttacgttttgaattcgtcgggtggggaccgaaagggactaagtcgggtcctaccggtctcctcgacgccctaccgaaccgaacgggcccctagttcccggtaccccttcccccgacggtacccctaccccgttccctacccgaacgaccgtaccctacccggttccgggaccgggggaccaacccggccgggtccccgggtccccgtcggggaccgttccggtacccggttcggtaaaccggaaaccggttaccctttacccgttacccgaacggttacgtaacgtccggtacggtacggacggccgggtacgacgggaacccgg

SEQ ID NO: 378711 - DNA, 627 bp, Homo sapiens
  misc_feature: GZ8MTXP02GBWZT.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggtcttcgtggaggcaccttcagcacctatacttcagtctgggtgcgacgacggcccctaggacaagggcttgagtggagtggggaggtactcccgtccgattcgttacggacaaaacccgacaccctacgcaacgactaacgttcccgaagggtacagacctacaacgacttaccggacggacgaaactccgaacgagacaacacgtacaacgagtacggagataggagtacgccgtagatatcgagaccgacgaccggtccgttagttactttcgtgtggacggaggagggacgggggtaccgtacggggtccgttacggggtaggttaacggttaaggttcgttacgttttacggatttaacggtcggtacggggtaaaccgg

SEQ ID NO: 378712 - DNA, 690 bp, Homo sapiens
  misc_feature: GZ8MTXP02IM101.38.26.C04.1.454.CMB.2.raw
  modified_base (246)..(246): a, c, t, g, unknown or other
  modified_base (433)..(433): a, c, t, g, unknown or other
  modified_base (445)..(445): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagcctgggtcctcggtgacggtcccctgcaagctcgnggagcacctcagcacctatacttcgagtcgtggtcgcgacgacggtccccgtggacaaggtcttagacggtaggagtggggaggtccgtccctccgtatccgtttacgaccaaaccactaccccgtacgaccacctaacgtacgttccgagacacgactaccgacgtaacgtaccggacgactaacnccgacagcaacngttaccacgagtacggagacgtgtaacgttacgacgttacggaagtacgttaccgaacggaccgaaccgaaccggggttcttagttacgtttacgtagtacggaaccggtagggaccgggggacgggggtaaaccggtcgggggtacccgttacgggggtaacccggggtttaaaggggtttcggttaacggtttacggtttaacggtaacggtttaacggtcgggttacccgggggtaaaccgg

SEQ ID NO: 378713 - DNA, 716 bp, Homo sapiens
  misc_feature: GZ8MTXP02H4S0F.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctggtagaacggtcccctgacaaggcttcgtggaggccacttcagcacctatacttcagcgtgggtcgcgacgcggcccctaggacgaagggtcttggagtggagtggggacggtactcccgtccgtattcgttacggaaccaaaccacacccgtacgacacaactacgtaccgaggacacgactcgacgtacgtaccgacgacgaactacccgaagacgacacgacgtactaacagtaggaagtagtacgaaggttacgaccgttaggaacgtacgttaccggaagaacccggaaccggtaccgggtaccggttagtttaacccgtttcgtagggtaccggtacgggaaggggtaaccgggggaacgggggacccgggtacggggggtaccgttaaccgggggtttaacggggttaaaaccgggtttggggttacgttaccggtttttaagggaaaacgtttcgggttaccggggttaacgggggaaaacccggg

SEQ ID NO: 378714 - DNA, 670 bp, Homo sapiens
  misc_feature: GZ8MTXP02HSJWY.38.26.C04.1.454.CMB.2.raw
  modified_base (250)..(250): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcaggtttggtgcagtcgtggggctggaggtgaagagccgtgggtcctggtgacggtccctgcgaggcttcgnggacgcaccttcagctacctattactttcgagtcgtgggtcgcgacgacggccccgtaggacgagggtcttggaggtggaggtaggggacgggtactcccgtcccgtagttcgttacggacctaaaccgactacccgtaccgaccaacaccgtaacgtcccgaggaccacgtacctacgaccgtaccgttacccggacggtaaccaacacccgaacggacgacacgtagtacctacgagtaggacgtatagtagttacgaccgttagaagtacgttacgacgaccgacggtaccggtccgtttagttacgtttgtcggttaggacggtaggggaacggggcggggacgggacggggtcgtacggggtaggttacggttaaggtcgttcgtttagacgtttacggtcggtacgggaaacgg

SEQ ID NO: 378715 - DNA, 690 bp, Homo sapiens
  misc_feature: GZ8MTXP02IEQFU.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcggacgaatccacgagcacagtctacagtggagatgagtacgctgagatcagacgacgcggcgtgttattcgtgtgcgaggaggacggggaccgaggggtcgtacgggtacggtaacggtttaggtgtcgttttaggattacgtcgggtaggggaaccaaagggggtactaaggttcggtacctacccggtaccttcccgtacgaccgtaccctacccgaacccggaacggtacccgtaacgttcccggttaccccttcccccgtacggacccctacccccgtacccgtacccgtaacgaccgtacccgtacccgtcggtacgggggaccaccggtaccggtcccggtcccgtcgggtccgtccggtccgtacgggtactaaacgggtccttaccgtaccgtacgtacgaacgtcgtaacgtcggacggtcggacgtacggacgg

SEQ ID NO: 378716 - DNA, 667 bp, Homo sapiens
  misc_feature: GZ8MTXP02IEUUZ.38.26.C04.1.454.CMB.2.raw
  modified_base (446)..(446): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagctgggtcctcggtgaagtccctgcaaggcttcgtggaggctaccttcagcaccctatacttcagccgtgggtcgcgacgacggcccctaggacaagggctttggagtggagtggggaggtactcccgtcccgtatcgtttggaccaaaccgacacccgtacgaccaacacgaacgttcccgaggtaccacgactaccgacgtacgtaccggacgaccgaactccacgagctaacgngtacaactagtcggaagagtgacgttacgaccgtagaagacgttcgagaccgaacgacgggtccgttagttactttcgtacggacgtacggaagggacggggaccgggggaccggtaacgggggtccgttacgggggttaacgggttaaaccgggtttggggttaacgtttccggttttaggaacggtttacggtccgggtttacgggggtaaaacccggg

SEQ ID NO: 378717 - DNA, 827 bp, Homo sapiens
  misc_feature: GZ8MTXP02JSEUM.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgcctcctcccgatctttggacaaaccacactacgcaacacaagttccaggacagactcacgataccgcgacgaatccagagcacagtctacagtggagatgagtagcctagagatcgtgaacgacgaaccggtccgttagttactttcgtgtacggacggaaggagggacgggggccgtaacgggggtccgttacggggttacggggttaaacggtttaggggttcgttacgtttttaggaacgtttacgtcggggtacgggggtaaccgtaaaacgggggtaaccgtaaagggttccgggtacccgtaacccgggttcccttaccccgtacccgtaacccggtacccccttaaccccgtaaaccccggaaacccggggtcccccgtaaaccggttccccggtttacccccgttccccccgtccgggaccccctacccccgttacccgtaaccccgaaacggtacccggacccttaacccggtaccgggtccgggggaccctacccggacgggccccgggtacccggtcggggtcccgttccggtcccggttacgggtaaccgtaaaccgggtaccttacccgttacccgtaacggttcgaaccgttccggaacgtacgggacggtacgggccgttacggaaccgg

SEQ ID NO: 378718 - DNA, 683 bp, Homo sapiens
  misc_feature: GZ8MTXP02J0EGN.38.26.C04.1.454.CMB.2.raw
  modified_base (259)..(259): a, c, t, g, unknown or other
  modified_base (276)..(276): a, c, t, g, unknown or other
  modified_base (320)..(320): a, c, t, g, unknown or other
  modified_base (422)..(422): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcgacgaatccagancacagtctacagtgganatagagtagctgagatctagacaccgacgtccgtagtatttcgnggtcgacgaggaggcggggccaaggggtctacgggtgggtaaccgtttggtcgttcgtttttaggacgttaacgttcggtacgggggaaccaaacggggtanaaacggttcggtaccacccggttcctacccgtccgacgtccctacccgaaccgaaccggggtcccacgttacccgggtcccctttccccgacgggtaccctaaccccgttccaaccggaacgaccgtacccgaaccgttccggcggggaaccaaccggcgtacccggcccgtcgggtcgttacgaccggttcggaacgaaacggtcctaccgttccgaacgttagcgttaccgacgtacggcggtccggacgtcggaacgg

SEQ ID NO: 378719 - DNA, 651 bp, Homo sapiens
  misc_feature: GZ8MTXP02GQO28.38.26.C04.1.454.CMB.2.raw
tcagtcgatcacgtcacgaccggtgctcgatttagtctagcgactttgggtttggggatggttttctcgatggggactgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagctgagatcgtgacgacgacggccgtgttatttcgtgtgacgaggaggacggggccgaggggcgtcgggtacggtaacgttaggtcgtcgttttgattagtcggtaggggaccgaaaggggtacaagtggtaccgtaccgtcctcctacgacgccctacccgaaccgaacgggccctacgtcccggtcccttcccccgtggacccctacccctcctacccaagaccgccgtaccgtcggtcggggaccacggacggcccggtcccgtcgggcctcggtcccgtggtaaccgaaacggtaccttaccgttacccgacggtacgtaacgtaccggtacgtcggacggtccgggacgtacgggaaccgg

SEQ ID NO: 378720 - DNA, 766 bp, Homo sapiens
  misc_feature: GZ8MTXP02IN8WY.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtcccagtcccaggtgcagttggtgcagtctggggctgaggtgaagagcctgggtcctcggtgaacggtcccctgcaaggtcttcgtggaggcaccttcagcacctatactttcagctgggtcgcgacgacggccccctaggaccgaggcttggagtggagtggggaggctcccgtccgtattccgtttcggaccaaaccgacacccgtaccgacaccacgtaacgttacccgaaggacgacgacctaccgaaccgtacgttaacccggacggaaccgaactcccgaacgtacgacacgtaacgtactaaccgagttaggaagtacgtaggaaggttacggtacccgttaggaaacgtacgttaccggtaacgaacccggtaacgtaacccggggttccggttaggtttaacgttttccggtaggtttacggaccgggtaaggggaacgggggtaaccggggggtacccggtaacgggggttcccggtttaccgggggttaacggggtttaaaccgggggttttaaggggttacgggtttaccggtttttacgggtaaggtttaccggttacccgggggtttaacgggggtaaaaccccgggg

SEQ ID NO: 378721 - DNA, 588 bp, Homo sapiens
  misc_feature: GZ8MTXP02GMUBQ.38.26.C04.1.454.CMB.2.raw
  modified_base (235)..(235): a, c, t, g, unknown or other
  modified_base (244)..(244): a, c, t, g, unknown or other
  modified_base (264)..(264): a, c, t, g, unknown or other
  modified_base (456)..(456): a, c, t, g, unknown or other
  modified_base (536)..(536): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctgggctgaggtgaagagctggtctggtgagtccctgcagctcnggagcactngcactatacttcagctggtncgacgacggcccctggacaaggcttggagtggagtggggaggactcccgtcccgattccgtttggaccaaacctacacccgtaccgacaaccgacaacgttccaaggaccctaagactaccaaccgtaacttaaccggaccggaaaccgaactacccgaacggacgacctacgacgtacctacagttagganagtgaaagtcgacctgagagttcgagaccgacgtacgggtcctaagttcttccgagcccgaggacgaagggcggggacgngggcgtcggtcggtaacggtgtgttcgtttaggattacgtcgtaggtaccgg

SEQ ID NO: 378722 - DNA, 599 bp, Homo sapiens
  misc_feature: GZ8MTXP02GYO0G.38.26.C04.1.454.CMB.2.raw
  modified_base (456)..(456): a, c, t, g, unknown or other
  modified_base (508)..(508): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcggtgaacggtcccctgcaaggcttcgtgggaggcaccttcagcacctatactttcagtctgggtcgcgacacggcccctaggaacaagggtcttggaggtggagtggggaggtctccctccgattccgtttggaccaaaccacaccgtacgacaacacaaacgttccaagggacagacctacaacgtactaccggacgacgaaactccaacgagcgaacagtacacatggaanagttggaagtcgacgtagagatacgagacgacgacggtcgtgttactttcgngtcgacgaggcgggacgggggccggtaaggggcgtacggggtacggttaaggtaagggtgttcgttagagtttacgacggtacgggaacgg

SEQ ID NO: 378723 - DNA, 662 bp, Homo sapiens
  misc_feature: GZ8MTXP02GL0QO.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttgcaaaccacactacgcacacagttccaggacagactcacgataccgcgacgaatccacgagcacagtctacagtggagatgagtagcctgagatcagaacgacgacggtccgtgttatttcgtgtcgacggaggagggacggggccgaggggcgtcggggtaggttaacggttaggtgtcgttttagattagtcggtaggggaccaaaggggactaagtcggtacctaccgtctcctcgacgccctaccgaaccgtaaccgggcccctacgttcccggttcccttacccccgtacggtcccctaccccctccgtaacccgaacgtacgacccgtaccgtccggtcggggaccaaccgacggcccggcccgtcgggccgtcggtcccgtacggaccgtaaacggtaccttaccgtacccgacgtacgaacgttaccggacgtacggacggcgggaccgtggaaccgg

SEQ ID NO: 378724 - DNA, 737 bp, Homo sapiens
  misc_feature: GZ8MTXP02IJTJY.38.26.C04.1.454.CMB.2.raw
  modified_base (277)..(277): a, c, t, g, unknown or other
  modified_base (297)..(297): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggacaaaccacactacgcacacaagttccaggacagactcacgataccgcggacaatcacgagcacagtctacagtgganatgagtagcctagagatcgngacgacgacggtccgtagtatttcgtggtcgacggaaggagggacgggggacccgagggggtccgttacggggttacgggttaaacggtttagggtcgtttcgtttttaggagttaacgttcgggtacgggggtaaccgaaaaggggtactaaaggttcggtacctaacccgtcctacccgtcgtaaccgcccctaacccgaacccgtaaacccggggccctaacgttccccgggtaccccttcccccgtacggtacccctacccccgtaccctacccgaaacgccgtaccccgtaaccgttccgggacggggaccgaccggtacgggcccggtcccgggtcggccgttccggtacccgtacgggtaaccaaacgggttcctttaaaccgtccgaacgttcggaacttcgacgcggtacggccggtacgtacggaaccgg

SEQ ID NO: 378725 - DNA, 685 bp, Homo sapiens
  misc_feature: GZ8MTXP02FF926.38.26.C04.1.454.CMB.2.raw
  modified_base (207)..(207): a, c, t, g, unknown or other
  modified_base (278)..(278): a, c, t, g, unknown or other
  modified_base (297)..(297): a, c, t, g, unknown or other
  modified_base (323)..(323): a, c, t, g, unknown or other
  modified_base (370)..(370): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggacaaaccncactacgcacacaagttccaggacagactcacgattaccgcgacgaatccacgagcacagtctacatgganatgagtacgcctgagatcngaccgacgacggccgttgtatttcgngtgcgaggagggacggggccaggggctcgggtaggttaacgttaggngtcgttttgattacgtcggtcgggggaccaaagggggtacctaagttcgggtacctacccggttacctcccttcgaccggacccttacccgaacccgaaccggggcccctaacgttcccgggttccccttcccccgtcggacccctacccccgtcctacccgaaacgccgacccgtacccgttccggacgggggccaaaccggacggcccggggtacccgtcgggggcctcggtccgtacggtaaccgaaacggtaccgttaaccttccgacgtaggtaacgtacggacgcggacgggcgggcgtcgggaaccgg

SEQ ID NO: 378726 - DNA, 745 bp, Homo sapiens
  misc_feature: GZ8MTXP02FLW3J.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagaagcctgggtcctcggtgaacggtcccctgcaaggcttcgtggaggcaccttcagcacctatactttcagcgtgggtgcgacgcggcccctggacgaagggcttggaggttggagtggggacgggtactcccgtaccgtagttcgtttcggactaaacccacacccgtaccgcactaactaacgttaccgaacgggtacaacgacctacgaaccgtaacttaacccgggacggtaaaccggaaaccttaccgaaacccggacgaccgaaccgacgttaccctaacgtaacggttagggaagtaagttaggaaaggtaacgtacccgttaggaacgttacgtaccggtaggaacccgaaccggtaaccggtcccggttacgtttaagtttccgtaggttcggacggacggggacggggaacgggggtcccggacgggggtaccggttaccgggggtaggggtttaaaccgggttggggttacggtttaccgttttagggtaacgtttacgggttacggtaccgggggtaaaccgggg

SEQ ID NO: 378727 - DNA, 693 bp, Homo sapiens
  misc_feature: GZ8MTXP02GNQ4J.38.26.C04.1.454.CMB.2.raw
  modified_base (318)..(318): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagctagagatctgacgacgcggcgtgtatttcgngtgacggaggacgggtacggggaccgaggggtccgttacggggtacggtttaaacggttggtcgttcgtttttaggacttaggtccgggtagggggacctaaaggggacctaaagtcggtaccgacccgttcccgtcctaccgccgtttacccacccgaaacccgtaacgggccccctagttccccggtcccctttacccccgcgggtaccccctacccccttcccgtaaccgaacggccgtacccgtaccggtccggtacgggggaccacggaccgggccggtccgtcgggccgtcggaccgttacggacgtaaacggtcctacgtacccgagttcgaacgttacggacgtacggcggtacggtcgacggaccg

SEQ ID NO: 378728 - DNA, 613 bp, Homo sapiens
  misc_feature: GZ8MTXP02IT663.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcgacaatccacgagcacagtctacatggagatgagtagcctgagatctgacgacacggccgtgtatttctgtgcgagaggacggggccgaggggctcgggtaggtaacggttaggtgtcttttgattactcggtggggaccgaaaggggactaagtcggacctaccggttctcccgtacacgtccctacccaacccgacgggcccacgtcccgtcccttcccccgcggcccacccctcccgtaccaacgcgccctaccgcgtcggggccacgcggccggtcccgtgggcctcggccgtggtaccgaaacggtaccttaccgtacccgtacgtcgaacgtcgacgtacggacggcggccgtaggaccgg

SEQ ID NO: 378729 - DNA, 637 bp, Homo sapiens
  misc_feature: GZ8MTXP02F4P4R.38.26.C04.1.454.CMB.2.raw
  modified_base (293)..(293): a, c, t, g, unknown or other
  modified_base (429)..(429): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagcctgggtcctcgggtgaacggtcccctgcaaggtcttcgtggaggctaccttcaagcaccttatactttcagtctgggtncgacacggcccctaggacaagggcttgagtggagtgggaggactcccgtccgagttctttaggacctaaaaccgcaacctaccgcaaactacaagttcccaagcacgactacacgtacttaccgcggaacgtaacnccgacgagaccaagtacgtactaacgagtggaatataggagtagccgtagatacgtacgtaggaacccgcgaccggtccgtacgttagttccgacgacggtacggaggacgggacgggggacccgaagggggtcttacggggtagggttaaaacgtttggggtgtttaccgttttaggacgtttaacggtcgggtacggggaaaccgg

SEQ ID NO: 378730 - DNA, 630 bp, Homo sapiens
  misc_feature: GZ8MTXP02JYVXD.38.26.C04.1.454.CMB.2.raw
  modified_base (419)..(419): a, c, t, g, unknown or other
  modified_base (440)..(440): a, c, t, g, unknown or other
  modified_base (504)..(504): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcggttggtgcagtctggggctgaggtgaagaagcctgggtcctcggtgaacggtcccctgcaaggcttctggaggcaccttcagcacctatacttcagcgtgggtcgcgacgacggcccctggacaagggcttgaggtggagtggggaggactccgtcccgtattccgttggaccaaaccacgactacccgacacactaacgtccaaggacagactacacgataccgcgacaatccagacncaacagtcctacagtcggaanatcggaacgtagccgtaggagtatcgtacggaacgaccgtaaccgggtccgttagtactttcgnggaccgcgggtaaggaacggggacgggggtccgaacgggggtccgttacggggttacgggttaaaacggtttggggtaagttcggttttagacgttacggtccggtacggggaacccgtaaagggg

SEQ ID NO: 378731 - DNA, 750 bp, Homo sapiens
  misc_feature: GZ8MTXP02GZU86.38.26.C04.1.454.CMB.2.raw
  modified_base (289)..(289): a, c, t, g, unknown or other
  modified_base (699)..(699): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaacgccgtgggtcctggtgaacggtcccctgcaaggcttcgtggaggcaccttcagcactatacttcagctgggtgcgacncggcccctggacgaggcttggaggtggagtggggaggtctcccgtacccgtattccgtttaggacctaaaccactaaccccgtaccgaccaaccgtaacctaacggttccccgaaaggtaccgacgtaaccttaccgaaactaaacgttacccggaacgggaaaccgaaaccgtccgaaacccggaaagccgtaaaccgtaacggtaccctaacgagttagggaactaaagtcggtaaacggttacgaccgttaaggaacgttaacttcgtaacggaaccggacctaaacccggggtccgtttaaggttaacgttttcggagtacgggaccgtaaaggggacgggtaaccgggggccgtaacgggggtcgtttacccgggggtaagggtttaaccggttaacggggtttntaaccgggtttttagaagtttaccggtttacggggacgggggtaaaacccg

SEQ ID NO: 378732 - DNA, 594 bp, Homo sapiens
  misc_feature: GZ8MTXP02HB19L.38.26.C04.1.454.CMB.2.raw
  modified_base (281)..(281): a, c, t, g, unknown or other
  modified_base (440)..(440): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctggtgaacggtcccctgcaaggcttcgtggagcaccttcagcacctatacttcagctgggtncgacacggcccctggacaggcttggagtggagtggggaggactcccgtccgtatcgttaggactaaaccgacaccctacgacacaacacgttccaaggcacgactacgacgtactaccgacggacgaactccacgacacaacagtactacagtaggaanagtgaaagtcgaccgtagacgacttacgagaccgacgtaccggtccgtagttacgtttcgagtcggacggaggacggggcggggacggacgggtcgtacgggtacggttaacggttggtcgttacgtttagagttacgtcgggtacggtaacgg

SEQ ID NO: 378733 - DNA, 626 bp, Homo sapiens
  misc_feature: GZ8MTXP02ICPJR.38.26.C04.1.454.CMB.2.raw
  modified_base (276)..(276): a, c, t, g, unknown or other
  modified_base (420)..(420): a, c, t, g, unknown or other
  modified_base (422)..(422): a, c, t, g, unknown or other
  modified_base (427)..(427): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggacaaaccacactacgcacacaagtccaggacagactcacgattaccgcggacaatccacgagcacagtctacatgganagtagagtagcctgaagatcgtagaaccgaccgaccggtccgttagttatttcgtggtgcgaggaggcggggccgaggggtctggtacggtaacgttaggtgtctttgatgtcgtgggacaaggactaagtcgcaccgtcctcncncgccncgtaccgacggcctacgtccggtcccttccccgacgccctacccctccgtaccaacgacgcctaccctcgggcgggacccacggaccggccccggtcccgtcgggtccctcggtccgttacgggactaaaccgggtaccttacccgttccgtaacggtcgtaacgtcggaacgtcggaccggtcggacgtcggaaccgg

SEQ ID NO: 378734 - DNA, 565 bp, Homo sapiens
  misc_feature: GZ8MTXP02GK871.38.26.C04.1.454.CMB.2.raw
  modified_base (259)..(259): a, c, t, g, unknown or other
  modified_base (322)..(322): a, c, t, g, unknown or other
  modified_base (486)..(486): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttnagcacctatactttcagctgggtgcgacaggccccctggacaaggcttgagtggatgggaggntcctccgatcttggcaaaccgcacctacgcacgacaagttccaggacagactacacgattaccgcggtaacgaaactcccaacgacgcaacgacgtctaaccatggaagatgaaagtacgaccgtagaagatacctgaaccgacgacggccgttagtatttcgngtgacgagaggacgggggccaggggctacgggtaggtaacgttaaggtgtcttttaggattagtcggtacggggaaccg

SEQ ID NO: 378735 - DNA, 657 bp, Homo sapiens
  misc_feature: GZ8MTXP02IX5XG.38.26.C04.1.454.CMB.2.raw
  modified_base (290)..(290): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagacgccgtggtcctcggtgaacggtcccctgcgaaggtcttcgtggagcctaccttcacgcaccttatcttcagcgtggtncgacgcggcccctaggacgaggtcttggaggtggagtgggaggactcccgtccgtacgttcgttacggaccaaaccgacctaccgtaccgacctaacgaacctaacgtcccgaacggacacggacctaccgaccgtacgtaccggacgtaacaaccgtccgacgacgacacgtagtactacgagtcgagagtggtacgtagccgtagagtacgtaccggtacgaaccgacgtacggtaccgttagtttagttccgtgtacggaggtagggacggggtacggggccggtacggggtccgtaggggtacggtttaacggttaaggttcggttacgtttaggacgtttacggcgggtacgggtaaaccgg

SEQ ID NO: 378736 - DNA, 659 bp, Homo sapiens
  misc_feature: GZ8MTXP02JUPVR.38.26.C04.1.454.CMB.2.raw
  modified_base (636)..(636): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagacgccgtgggtcctggtaggaacggtcccctgcgaaggtcttcgtgggaggcctaccttcacgacctaacccttattaccgttcaggtcgtgggtcacgaccgaccggcccctaggaacgaggtcttggaggtcggagtggggacggtactcccgtccggtattcgttacgaccaaaccgacaccccgtacgacaactacgtacgtaccgaaggtaccagacctacgacgtaccgtacccggacggtaaccacgtaccgacgacgacacgtaagacctagagtagagtacgagtacgcgtaccgagagtactacgagaccgtaacgtcggtcgttagtaccgttgacggtgtacgggagggacgggggcgggacggtacggggtccgttggggtaacggttaggtaacggtcgttacggtttaggngttacggtcgggacggtaaccgg

SEQ ID NO: 378737 - DNA, 733 bp, Homo sapiens
  misc_feature: GZ8MTXP02GM0WF.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccagagcacagtctacatggagatgagtagcctgagatctgacgacacggccgtgtatttctggtgcgaggaggacggggccaggggctcgggtaggttaacggttagggtgtcgtttttgaattacgttcggtacgggggaccaaagggggtactaacgtcgggtaccacccgttcctcccgtcgtacgccctacccgaacccgaaacgggccccgtaacgttcccggtacccttccccccgtcggacccctaaccccctcccgtaccccgaaacggaccgacccgtacccgttccggtaccgggggacccaccggaaccggccccgggtcccgtcgggggtcccgtaccggtccccggttcggggtaaacccgtaaacggggtacccttaacccgtttacccggaacccggttagtaacccggttaccgaacgggttaccggacgggtcccggggtaccggttaccgggaaccggg

SEQ ID NO: 378738 - DNA, 674 bp, Homo sapiens
  misc_feature: GZ8MTXP02I7U8D.38.26.C04.1.454.CMB.2.raw
  modified_base (279)..(279): a, c, t, g, unknown or other
  modified_base (323)..(323): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctacctcccgatctttggcaaaccacactacgcacacaagttccaggacagactcacgattaccgcggacgaatccagagcacagtctacagtgganatgagtagcctgagtatctgacgacacggtccgtagtatttccnggtacgaccgaggacggtacgggggccaggggtcctcggggtaggtaacgtttagggtcgtacgttttagattagtcgggtggggtacccaaaggggtacaaagttcggtaccacccgtcctccgtacgacctcccgtaccaaccgacggccctacgtcccggtcccttcccccgtacggtccctaccccgtccctaccgaacgaccgacccgtaaccgttccggtacgggggaccaccgacggttcccggcccgtacgggcctccggtcctacgggttaccgaaacggtacttacccgttaccgaacgttcgaaacgtccgaacgtcggaaccggccggaacgcgaacgg

SEQ ID NO: 378739 - DNA, 660 bp, Homo sapiens
  misc_feature: GZ8MTXP02G0GD8.38.26.C04.1.454.CMB.2.raw
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtattctgtgcgagaggaggggccaggggctcgggtacggtaacgttaggtgtcttttggattagtcgtggggaccaaaggggacaagtcgggtctacccgtctccgtcgacgcctccgacccgaacgggccctacgtcccgggtacccttcccccgtcggtcccgtaccccttccgtacccgtaaacgacgtacccgtaacctcggtcgggggacctacgacggcccggcccgtgggccttacggcccgtacgggttaccgaaacggtacccgttaacgttaccccgtaacggttacggtaacgttaccggtaacgttcgggaacggtccggggtactcggggaaccgg

SEQ ID NO: 378740 - DNA, 687 bp, Homo sapiens
  misc_feature: GZ8MTXP02IIZRR.38.26.C04.1.454.CMB.2.raw
  modified_base (352)..(352): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttcgtggagcaccttcagcactatacttcagctgggtgcgacaggcccctggacaggcttgagtggagtgggacggactccgtccgtattcgtttacggacctaaaaccnctacccgtaccgcgaactaacgaacgtttcccgaaggtaccaacgactaccgaacgtaccttaccggacggtaaccgaactaccgaacgaagccaacaggtacctaacacgtaggaagagtaggaagtacgaccgttaggaacgtacgttacgacgaaccggaaccgtaccgggtccgtttaggttacgttttacgtcgggttacgacgggtacgggaaagggggaccgggggttaccggaacgggggtccgttaacgggggttaacggtttaacgggttaacgggtcggtacgtttaccgttaggtaacgttcggtttaccgggtaaccggggg

SEQ ID NO: 378741 - DNA, 666 bp, Homo sapiens
  misc_feature: GZ8MTXP02IGUEZ.38.26.C04.1.454.CMB.2.raw
tcagtcgatcacgtcacgaccggtgctcgatttagtctagcgactttgggtttggggtatggttttctcgatgggggctgggagggctttgttggagaccttgcacttgtactccttgccattcagccagtcctggtgcaggacggtgaggacgctgaccacacggtacgtgctgttgtactgctcctcccgattctttggacaaaccacactacgcacacaagttccaggacagactcacgattaccgcggaacaatccacgagacacagtctaacagtggagatgagtacgcctgagatcgtagacgacgcggccgtagttatttcgtgtgacggaggacggaggggccgaggggtcgttacgggtacgggtaacgttaggtcgttcgttttagattacgtcgggtacggggaaccaaaggggtactaagttcgggtacctacccgtacctcctaccgacgtccctacccgaacccgtaccgggaccctacggttcccgttccccgttaccccgtcggaccctacccctccctaccgaacgaccgtccgaccgtcggacggggaccacgcggccggccgtcggctcggtaccgtcggacgaacggtaccttaccgtccgtacgtacgtaacgtcgacgtacggacggccggtacgtacgaacgg

SEQ ID NO: 378742 - DNA, 609 bp, Homo sapiens
  misc_feature: GZ8MTXP02HEVSS.38.26.C04.1.454.CMB.2.raw
  modified_base (249)..(249): a, c, t, g, unknown or other
  modified_base (447)..(447): a, c, t, g, unknown or other
  modified_base (508)..(508): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagccgtgggtcctcggtgaacggtcccctgcaaggcttcgnggagcaccttcagcacctatacttcagctgggtcgcgacacggcccctggacaagggcttgaggtggagtggggaggactcccgtccgattcgtttaggaccaaaccgcaccctacgcacaacactccgagaccagtactacacgtaacttaccggacgtaacgactccaacgacgacacagtactacgagtacgganagtagagtacgccgtgacgtagtcgtacgaccgacgtaccggtccggttattacgtttcgngtacggacggacggaggggacggggcggtaacgggggcgtacggggttaggttaacggttaagggtgttcgtttagagtttacgtcggtacgggaaaccgg

SEQ ID NO: 378743 - DNA, 684 bp, Homo sapiens
  misc_feature: GZ8MTXP02IQ53C.38.26.C04.1.454.CMB.2.raw
  modified_base (249)..(249): a, c, t, g, unknown or other
  modified_base (257)..(257): a, c, t, g, unknown or other
  modified_base (365)..(365): a, c, t, g, unknown or other
  modified_base (658)..(658): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctggtcctggtgaacggtccctgcgaagcttcgtggngcaccttnagcacctatactttcagtcgtgggtgcgaccgacggcccctaggacgaagggctttggaggtggagtggggaggactcccgtaccggtattcgtttggaccaaaaccncaccccgtaccgaccaacaccgtaacgttaccaacgacgacgacctacgaaccgtaccgttaccggaccggtaaaccgaacgtacccgaaccggagacccaaacgtaccgtaactaaccgtagtacggaaagtacgtaggaagtacgaccgttaggaagtactcgtaacggaccgacgaccggtccgttagtttacgtttcgtgtaccggtacgggagggacgggggtacgggggaccggtacgggggtcggtttacggggtaggtttaacggtttggtcgtttcgttttagngtttaacgtcggggtacggtaaacgg

SEQ ID NO: 378744 - DNA, 642 bp, Homo sapiens
  misc_feature: GZ8MTXP02GGNZL.38.26.C04.1.454.CMB.2.raw
  modified_base (277)..(277): a, c, t, g, unknown or other
  modified_base (319)..(319): a, c, t, g, unknown or other
  modified_base (494)..(494): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccagagcacagtctacatgganatgagtagcctgagatcagacgacacggccgtgtactttcgnggtgcgagagggacggggtccgtaagggggtttcggtagggttaaacggtttgggtcgtacgtttttagaagttacgtcggtgggggacctaaaggggactaaagtcgggtaccaccgttctccctacgaccgccctaccgaacgaacgggcccagttcccggtcccttccccgngaccctacccctccctaccgaacgtcgacctaccgtcggtacggggccacgacgccggtcccgtggggctcgccgtaggtaccgaacggtaccttaccgttcccgaagttcgacgtccgacgtggacggcggacgtcggacgaacggg

SEQ ID NO: 378745 - DNA, 689 bp, Homo sapiens
  misc_feature: GZ8MTXP02G9ASI.38.26.C04.1.454.CMB.2.raw
  modified_base (322)..(322): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgaccgacgacggtccgtgtatttcgngtgcgaggaggacggggccgaggggctacgggtaggtaacgttaggtgtctttagagttagtcgggtacggggaccgaaagggactaaggttcggtaccgtacccgttccgtaccctacgaccgtcccctacccgaaacccgtaaacgggccccctaacgttcccggttccccttcccccgtcggaccccctacccccgtcccgtaacccgaaacgaccgtacccgtacccgttaccggcggggacctacggaccgggcccggcccgttcgggcccgtccggtcccgttacggtaaccgtaaacggtaccttaccgttaccgacggttcgaaccgtcgacgtacggacggccggtcgacggaaccgg

SEQ ID NO: 378746 - DNA, 712 bp, Homo sapiens
  misc_feature: GZ8MTXP02GVQ3X.38.26.C04.1.454.CMB.2.raw
  modified_base (273)..(273): a, c, t, g, unknown or other
  modified_base (617)..(617): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctgggtcctggtgaacgtcccctgacaggtcttcgtggagcaccttcagcactatacttnagcgtggtcgcgacgacggcccctaggaacgtaacgggtctttggaggttggggaacggttgggggaacggggtacccgtttcccccgttaaaccccggtacgtttaccggttttaccggggaacccaaaaaaccccgtaccgaaccccgttaacccggacctaaaccgtaaaccgtaaaccggttaccccgaagggtaccacggaaccttaccgaacgtaaccgttaacccgacgggtaaccgaaactacccgaacgaagaccaacgtacgtacctaacgagtacggagacgtagacgtagcctggactagtacgagaaccgacgaccggcgttattacgttntgtcgaggtacgggaggacggggtcggacgggtccgtagggtacggttacgttaagggtgttacggttttagagttcgtacggtacgggtaacgg

SEQ ID NO: 378747 - DNA, 711 bp, Homo sapiens
  misc_feature: GZ8MTXP02IB861.38.26.C04.1.454.CMB.2.raw
  modified_base (244)..(244): a, c, t, g, unknown or other
  modified_base (313)..(313): a, c, t, g, unknown or other
tcagtcgatcacgtcacgaccggtgctcgatttagtctagcgactttgggtttggggatcacataacaaccacattcctcctctaaaagaagcccctgggagcacagctcatcaccatggactggacctggaggttcctctttgtggtggcagcagctacaggcgtccagtcccaggtgcagttggtgcagtcgtggggctggaggtgaagagctggtcctggtgacgtccctgcaggcttcgnggaggcacttcagccacttatacttcagctgggtcacgacgcgccccgtaggacgaggcttgaggtggngtgggaggctccgtccgattcgtagaccaaacctacaccctacgccaaccaactacgtaccgacggacctacgaccctacgacgtaacttacccgggcggaaacgtaactcccgacgacgactaacacgttacacgagttacgggaagagtggtaaagtcggtaccgtagtacgtaacgtcgtaacgggaacccgtaacggacccggttacggttacgtttaacggtttccggttaaggtcgggtaaccgggtaggggaccgggggttaaacggggggcccccggtaaaggggggtcccggttaacgggggtttaacccgggtttaaggggtttaacgggttcggtttaaccggtttaggtaaccgtttaggttaccgggggtacgggggtaaaccgg

SEQ ID NO: 378748 - DNA, 734 bp, Homo sapiens
  misc_feature: GZ8MTXP02IWCWK.38.26.C04.1.454.CMB.2.raw
  modified_base (288)..(288): a, c, t, g, unknown or other
  modified_base (360)..(360): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctggtcctggtgaacggtcccctgcaaggcttcgtggaggctaccttcagcacctatacttcagtctgggtgcgacncggcccccgtggacgtaggcttgaggtggagtggggaggactcccgtaccgtattcgttcggacctaaaccncaaccctacgacgtacaacgtaacgttcccgaggtacacgtacctacgaacgtacgttacccggacggaaccgaaactcccgaacgacgaccacgtagtactaacgagttacggaagtagtacggtaaacgtacgtaccgttagggaaagtacgttaccggtacgaaacccggaccggttaaccggggttacccggtttaggtttaccgtttacgtgggttaaccggtacggggaagggtaacgggggaccggggggtaccggtaacgggggtcggttaacccgggggttaggggtttaaaaccgggtttggggttcggtttaccggtttttaggaacgtttacgggttacggggttaaccgggggtaaaccgg

SEQ ID NO: 378749 - DNA, 669 bp, Homo sapiens
  misc_feature: GZ8MTXP02FXO7A.38.26.C04.1.454.CMB.2.raw
  modified_base (246)..(246): a, c, t, g, unknown or other
  modified_base (275)..(275): a, c, t, g, unknown or other
  modified_base (323)..(323): a, c, t, g, unknown or other
  modified_base (430)..(430): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgngacaatccacgagcacagtctacatgganatgagtagcctagagatcgtcgaacgacgacggtccgtgttatttcgnggtgacgaggagggacgggggccgaggggcttcggtacggtacgttagtgtcttttgattagtcggtcggggaccaaaggggacaagtcggtccgtaccgtcctccncgactaccctaccgaaccgtaaccggcccctaacgttcccggttacccttcccccgtacggacccctacccccgtaccctacccgtaaacgcgtacccgtaaccgtccgtcgggggaccacggacccggttcccgggcccgtcggggcccttcggtccggtaggttaccgaaacggtacctaccgttacccgagtaccggaacgacggtacgtacggaccggtcggacgtccggaacgg

SEQ ID NO: 378750 - DNA, 663 bp, Homo sapiens
  misc_feature: GZ8MTXP02GQ51R.38.26.C04.1.454.CMB.2.raw
  modified_base (241)..(241): a, c, t, g, unknown or other
  modified_base (244)..(244): a, c, t, g, unknown or other
  modified_base (248)..(248): a, c, t, g, unknown or other
  modified_base (251)..(251): a, c, t, g, unknown or other
  modified_base (468)..(468): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagcctggtcctcggtgacgtccctgcagctcgnggnggcnctnagcactatacttcagctgggtgcgacgacggcccctaggacgaagggcttaggacggtgggagtggggaggtactcccgtccggtattcgttcggacaaaccacaccctacgacacaacacgttaccgaaggtacagactacgaccgacgttaccgacgaacgacgtacaacgcgacacagtacacgagtacgggatagtacgtaagtacgccgtanaggcttacggacggaaccgtaaccggacgggttacccgttaggtttcctttcggtaggtcgggaccgggagggtaaacggggcgggggtaccggaacgggggtccgggtttacggggtaacggggtttaaccgggttaaggggtttacgttacggttttagaaggtttacggtcggggtttacgggggaaaccgg

SEQ ID NO: 378751 - DNA, 740 bp, Homo sapiens
  misc_feature: GZ8MTXP02J1Q55.38.26.C04.1.454.CMB.2.raw
  modified_base (243)..(243): a, c, t, g, unknown or other
  modified_base (277)..(277): a, c, t, g, unknown or other
tcagtcgatcacgtcacgaccggtgctcgatttagtctagcgactttgggtttggggatcacataacaaccacattcctcctctaaagaagcccctgggagcacagctcatcaccatgtactggacctggaggttcctctttgtggtggcagcagctacaggtgtccagtcccaggtgcagttggtgcagtcgtgggctgaggtgaagagccgtgggtcctggtgacgtccctgcagtcttcnggagcactcagctactatacttcagtcgtggtcncgacgccggccccgtaggacgtaggtcgtaggacggtaggaggtggggacggtacctcccgtaccgtagttcgttacggaaccaaaccgactacccgtaccgacaactaaccgtaacgtaccggaacgtcgaactaccgtacgtaaccgaccgttaccggaaccggaaccgaaaccgtacccgaaacgaacggacctaaaccgtacggtaccttaccgaacggttagggaaacgtacgtaacgggtactttaacggacgtaaggacgttacttaccgggaacggaccgtaacccggtaaccgggttccgttaacgttcgtttaccgagggtaccgtaggggtaacgggaacgggggccgggggtaaaccgtcgggggtacgttacgggggttaacggggttaaccggttaagggttcgttaccgttttaggagtttacccggtacgggaacggggtaaacggg

SEQ ID NO: 378752 - DNA, 664 bp, Homo sapiens
  misc_feature: GZ8MTXP02GLT5U.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacacggccccgtggacgaaggcttggaggtggagtggggagggactcccgtcccgattcgtttgaccaaaccacacctacgcaacacaagttccaagcagactacgacgacttaccgcgacgaaactccgaacgagacacgtacgtactacacgtggagtagtgaaagtagcccgttagagtactccgtagaaccgtaccgaacgacgtaccggttgttacctttgtcggtacggaccggagggtaaacggggacggggggtaacccggacgggggtaccgttacgggggttaacggggttaaaacccggggtttaggggtttacgtttaccggtttttaaggtaacggtttaacgttacggggttaacccgggggg

SEQ ID NO: 378753 - DNA, 734 bp, Homo sapiens
  misc_feature: GZ8MTXP02JW361.38.26.C04.1.454.CMB.2.raw
  modified_base (289)..(289): a, c, t, g, unknown or other
  modified_base (294)..(294): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaacggtcccctgacaaggtcttcgtggacggcaccttcagccacctatactttcagcgtgggtncgacncggcccctaggacaaggtcttgaggtggagtggggaggactcccgtcccgtatcgtttcgaccaaaccacaccctacgacacacgaacgttccgaaggaccacgaactccgaacgtacgttaccggacggacgaaactcccgaaacgacgacacgtagtactaacagttagggaacgtagtagaacggtacgtacccgtaggtaacgtacgtaccgtaaggaaacccggaacggtaacccggggtccccgtttaggtttaaaccgtttccggttaggttacggtaaccgggaaagggtacggggaaaccggggggtcccggtaaacggggggtccgggttacgggggttaacggggtttaaaccggggtttaagggttacccggtttacggtttttacggaaggtttacggttaccggggttacgggggtaaaacccggg

SEQ ID NO: 378754 - DNA, 649 bp, Homo sapiens
  misc_feature: GZ8MTXP02JK4SF.38.26.C04.1.454.CMB.2.raw
  modified_base (289)..(289): a, c, t, g, unknown or other
  modified_base (432)..(432): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggtcttcgtggaggccaccttcagcacctatacttcagtctgggtcncgacgacggcccctaggacaagggcttggagtggagtggggaggtactcccgtccgtatcgtttacggaccaaaccgcaccctacgcacactagttccaaggcagtactacacgtagtaccgacggacgaaactccgaacganacgacacgtacaacagtaggagatagagtacgcctaggacgtactcgtacggaaccgacgtaccgggtccgtttagttaacgtttcgtacggttacggtacggagggtacggggacgggggtaccgtacgggggtacgttaccggggttagggttaaccgggttaagggttcgttacggtttacggaagtttacgttccgggtacgggtaacccggg

SEQ ID NO: 378755 - DNA, 703 bp, Homo sapiens
  misc_feature: GZ8MTXP02JI31Q.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcacttcagcacctatacttcagtcgtgggtgcggactacggccccgtaggacgaacggcgtttgaggtggagtggggaacggtacttccccgtacccgtagttccgtttacggaaccaaaaccctacgaaccccgtaccgacctaaccgaactaacgttaccgaagggaccacgaacctacgaaccgtacgttacccggacgtaaacgaactcccgaacgagacacaacgtcctaagagtaggaacgtataggaacgtacgtacccgaggtacgtaacttcgaacgaaccgtacgaacccgggtcccgttaagttacgtttacggtcgtacggtacggacgggtaagggggaccgggggccgtaacgggggcgtttaccgggggtacggttaaagggttcggtacgttaccgttttaggacgtttacggtcgggttacgggtaaaccgg

SEQ ID NO: 378756 - DNA, 786 bp, Homo sapiens
  misc_feature: GZ8MTXP02F64JE.38.26.C04.1.454.CMB.2.raw
  modified_base (274)..(274): a, c, t, g, unknown or other
  modified_base (284)..(284): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagcctgggtcctcggtgaacggtcccctgcaaggtcttcgtggagcacttcagcactatacttnagcgtgggtncgacgacggcccctaggacgaacggcttaggaggtggacgtggggaacggtacgtcccgtacccggtagttcgtttacgggaccaaaacccgtacctaacccgttacccgaccgtaaaccgtaaaccgtaaacggtttaccccggaaacgggttacccgaacggtaaaccgtccgtaaaacccggtaacgttaaaccccgggaaaccggggtaaaccgaaaccgttaccccgaaaccggaacgtaaccaaaccgtacggttaaccctaaccgtaacgtaggaagaacgttagaaacggttacgacccgttaggaagtaactacggtagaaccggacgaccgggtacccgtagttatttccgtggttcggacgtaggggtacgggacgggggtaacccgtacgggggtaccggttacggggttacggggtttaaaccggtttaaggggttaacggtttcggttttaggacgtttaccggtacgggtaacggggtaaacccggg

SEQ ID NO: 378757 - DNA, 596 bp, Homo sapiens
  misc_feature: GZ8MTXP02JYASF.38.26.C04.1.454.CMB.2.raw
  modified_base (486)..(486): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacgacggccgtgtatttcgtgtgcgaggaggacggggccgaggggcgtcggtacggtaacgttggtgtcgttttgattagtcggtggggaccgaaaggggacaagtcggtcaccgtctcctcacgccctccgaaccgacgggccctacgtccgtccctccccgtgcccacccctcctaccaagtcnccgtaccgtcgtcggggcacgcgccggccgtggctcggccgtggaccgaaacggtaccttaccgtccgtacgtcgtaacgtcgacgtcggacggccggcgtacggaccgg

SEQ ID NO: 378758 - DNA, 632 bp, Homo sapiens
  misc_feature: GZ8MTXP02HPS9A.38.26.C04.1.454.CMB.2.raw
  modified_base (178)..(178): a, c, t, g, unknown or other
  modified_base (249)..(249): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtncagttggtgcagtctggggctggaggtgaagagcctgggtcctggtgaacggtcccctgcaaggtcttcgngggagcacttcagcacctatacttcagcgtggtgcgacgcggcccctggacgagggcttggaggtggagtgggaggtctcccgtccgtattcgttacgacctaaaccacacctaccgacacaacctagtccgagacacgactacgaacgtacgtacggacgtaaccgacaccgaacgacactacgagttacacgagtggaagagttacgagtacgtctagtaacgtatccgagaaccgaccgtaacggtcccgttagtttacgtttcgacggccgtaggaacgggacggggtacgggggcccgggtaagggtccgtacggggttaacggttacgggttaacggttgttacggtttagacgttacggtcggtacgggtaaacgg

SEQ ID NO: 378759 - DNA, 719 bp, Homo sapiens
  misc_feature: GZ8MTXP02FJ918.38.26.C04.1.454.CMB.2.raw
  modified_base (194)..(194): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggaactggaggttcctctttgtggtggcagcagctacaggtgtccagtcccaggtgcagttggtgcagtcgnggggctgaggtgaagaagcctgggtcctcggtgaacggtcccctgcaaggtcttctggaggcaccttcacgcactatactttcagctgggtgcgacacggcccctaggacgaggctgagtggagtggggaggactcccgtccgagttcgttacggacctaaaaccactaccccgtacgaccaacaacgtaaacgttcccgaagggacacggacttaccgaacgtaacgttacccggacgggaaaccgtaaacgtaccccgaacggacggtaaccaacgtaaccggtttacctaaacccggtaagttacggggtaaagaaacgttagggaaacgggttaaccggaccgttaaggaacggtaactaccggtaacggaacccgacgtaacccgtaccgttgtttacttcgtggttaccgacggtaaggacggggacgggggtacccgagggggtccgtacggggttacgggttaaacggtttaagggtacgttcgtttagacgtttagtcgggtacggggtaaaccgg

SEQ ID NO: 378760 - DNA, 711 bp, Homo sapiens
  misc_feature: GZ8MTXP02I21WS.38.26.C04.1.454.CMB.2.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagaagccgtgggtcctcggtgaacggtcccctgcaaggcttcgtggaggcaccttcagcctacctatacttcagtcgtgggtcgacgacacggcccctggacgaggctgaggtggagtgggaggctcccgtccgattcgttagaccaaacacaacccgtacgaccaacgaacaacgttaccgaacgtacaacgaccgtacgtaaccgtaacgttacccggacggtaaacccgtaaactcccgaacgaacgtaccaacgtaacgtactaccgagtagggaagtagacgtaaaggtcgaccgtaagggatacgttacgaacggaaccggacgtaacccggggtccgtttaaaggttctttaccggtaggttcggaaaccggtagggaacggggaccgggggtaaccggtacgggggtaccgtttaccgggggtacggtttaaaacggggttcggttacgtttaccgtttacggtagttaacggttccggggtacggggaaacccgg

SEQ ID NO: 378761 - DNA, 616 bp, Homo sapiens
  misc_feature: GZ8MTXP02I0TZQ.38.26.C04.1.454.CMB.2.raw
  modified_base (144)..(144): a, c, t, g, unknown or other
  modified_base (302)..(302): a, c, t, g, unknown or other
  modified_base (334)..(334): a, c, t, g, unknown or other
  modified_base (391)..(391): a, c, t, g, unknown or other
  modified_base (411)..(411): a, c, t, g, unknown or other
  modified_base (468)..(468): a, c, t, g, unknown or other
  modified_base (486)..(486): a, c, t, g, unknown or other
  modified_base (518)..(518): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgnggtggcagcagctacaggtgtccagtcccaggtgcagttggtgcagtctggggctggaggtgaagaagcctgggtcctggtgaacggtcccctgacaaggcttcgtggacggctaccgttcaagccacctattacttcacgtctagggtgacgtaccncggcccctaggaccaagggccttggaggtggngtagggacggtactccctccgtatcgttcggaccaaacgtacaccgtacgcacctanacgtccaggtctacggaacncgtaacacttaccgacggaacaacgttccaacgcgacacagttacacagttgaatgngagttacgcttagagtancgtagacgaccgtagcctttaggtctttacgngtacgacggtaggacgggtcgggacgtacgggtacgttacgggttacggttaacggttgttcgtttacgttagtacgtttaccggcggtacggtaccg

SEQ ID NO: 378762 - DNA, 652 bp, Homo sapiens
  misc_feature: GZ8MTXP02GVX5B.38.26.C04.1.454.CMB.2.raw
tcagtcgatcacgtcacgaccggtgctcgatttagtctagcgactttgggtttggggacataacaaccacattcctcctctaaagaagcccctgggagcacagctcatcaccatggactggacctggaggttcctctttgtggtggcagcagctacaggtgtccagtcccaggtgctaggttggtgcagtcgtggggctggaggtgaagagtccgtgggtcctcggtgaacggtcccctgacgaaggtcttcgtgggacggcctaccttcagctaaccttatacttcagtcgtggcgcgacacggtcccctggaacgaggtctaggaggtggagtaggggacgtcgtccctaccggagttccgttaggaaccaaaccaccactacgaccacaactaacgtcgaagacagcctacgaacgtacgtaccgacggaacactccgaacgacgacacagtacaacgtagtacgaagtagtagaagtacgtaccgtagatacgtacgtacgacgacgacggtaccgttagttacttgtgtgacggaggacgggacggggtacggacggggtacggttacgggttacgggttaaaggtcgggttacgtttaaggtttagtaacgttacggtacggtaccgggaacggtaaggtaaccgg

SEQ ID NO: 378763 - DNA, 737 bp, Homo sapiens
  misc_feature: GZ8MTXP02IM9IS.38.26.C04.1.454.CMB.2.raw
  modified_base (274)..(274): a, c, t, g, unknown or other
  modified_base (294)..(294): a, c, t, g, unknown or other
  modified_base (479)..(479): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtcaacanggagatgagtagcctgagtntcagacgacgacggccgtgttaactttcgtggtgcggaggacgggacgggggccgaggggccgtacgggttggggttaaaaccggttagggttcgttcgtttttagaacgttacttccgggtagggggtaaacccgaaagggggacctaaaggttcggggtaccctacccggttcctcccttacncgtccctacccgaaccgtaaccgggccctaacggtcccggttcccctcccccgtcggcccctaccccttacctacccgacgtacgaccctacccggtcggtaccgggggccaccgacgggtcccggtccccggtcgggtaccgtccggtcccggttacgggtaacctaaaccgggtaccttaaccggtttcccgaaacggttccgtaacgtcgggtaaaccgtcggggaacgcccgggggtaccgtcggggaaaccgg

SEQ ID NO: 378764 - DNA, 652 bp, Homo sapiens
  misc_feature: GZ8MTXP02ILNCY.38.26.C04.1.454.CMB.2.raw
  modified_base (247)..(247): a, c, t, g, unknown or other
  modified_base (354)..(354): a, c, t, g, unknown or other
  modified_base (475)..(475): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctggtcctcggtgacggtcccctgcaaggcttcgnggaggcaccttcagcacctatacttcagctgggtgcgacaggcccctaggacaaggtcttgaggtggagtgggaggactccctccggtacttcgttcgaccaaaccnctaccctaccgcgaaccactaacgttccgacggacacgacctaccgaacgtaccgttaaccggacggaaaccgaacgtacccgaaccgacgtaccacgtaacgtacctacgactagggaanagtagaacgttacgaccgtaggagtacgtacgtacgaacgaccgtacggtcgttcgttagtttcgtagtcggacggtaggacgggacgggggacggacggggtcggttaccggggtaggtttaacggttaacggttcgtttacgtttaggtacgtacggtcggtacggggtaaccgg

SEQ ID NO: 378765 - DNA, 655 bp, Homo sapiens
  misc_feature: GZ8MTXP02JA85R.38.26.C04.1.454.CMB.2.raw
  modified_base (186)..(186): a, c, t, g, unknown or other
  modified_base (473)..(473): a, c, t, g, unknown or other
  modified_base (492)..(492): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggngcagtcgtggggctggaggtgaagagccgtgggtcctcggtgtaacggtccctgacgaaggtcttcgtggagctacctcagcactatacttcagcgtggtgcgacacggcccctaggacaggcttagaggtcggagtggggaggcttcccgtccggtattccgttaggacctaaaccacgtacctaccgaccaacaccgtaacgtaccgaacgacgactaaccgcacgtaacgtaccggacgaaacgactacccgaagacgacacggtctactacgagtcgggaaanagtcgagtctacgtagacngttacgaacgaccgacggtacggtcgtttagttcgttaggtcggtcgacgggtaagggacgggggacgggggacggtaacggggttccggtagggggttacggtttacggtttgggttcgtttacggtttaggtacgtacgggttacgggtaacggggaacgg

SEQ ID NO: 378766 - DNA, 676 bp, Homo sapiens
  misc_feature: GZ8MTXP02I805O.38.26.C04.1.454.CMB.2.raw
  modified_base (249)..(249): a, c, t, g, unknown or other
  modified_base (252)..(252): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagacgcctgggtcctcggtgaacggtcccctgcaggtcttcnggngcaccttcagcactatacttcagtctgggtgaccgacgacggccccgtggacgtaagggcttggaggtggagtggggaggtactcccgtccgtaagttcgtttcggacctaaaccacaccccgtacgacctaacaacgtaacgtccaacgggacacgactaccgaacgtacgttaccggacggtaacgaactcccgaacgacgtacaacgtagtacacctaagtggaatacgtagtaacgtcgtaccgaggtagtaactacgtacggaaccgaccgtaccggtccgttagttactttacgtcgtaggacggagggtacgggggacgggggacccgtaagggggtcggttacgggggtaacggtttaacggggttaaggtcggtttagttttaacggagtttacggtcggtacgggggtaaaccg

SEQ ID NO: 378767 - DNA, 723 bp, Homo sapiens
  misc_feature: GZ8MTXP02I8GOC.38.26.C04.1.454.CMB.2.raw
  modified_base (276)..(276): a, c, t, g, unknown or other
  modified_base (712)..(712): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaacgttccaggacagactcacgattaccgcgacaatccagagcacagtctacatgganatgagtagcctgagtatcgtagaccgacgaccggtccgtagttactttcgtggtacggcggaggacgggtacgggggccgaggggtccgttacggggtacggttaacggttaggttgtacgtttttagattacgtcggtacggggaccgtaaagggtaccaagttcggtcctaccgtcctccgtacgaccgtcccgtacccgaacccgtaacgggccccctaagttcccggttacccccttcccccgtcggacccccttaacccccgtacccgtaacccgtaacgacccgacccgttaccccgtacgggtcgggggaccaccggacggcccggtccgtacgggcccgttcggaccgttacggaccgtaaacggtaccttaccgttaccgaccggtttagaaccgtaccggtacgttacggggacgtcgggtaccgngggaaacccgg

SEQ ID NO: 378768 - DNA, 575 bp, Homo sapiens
  misc_feature: GZ8MTXP02FI5SR.38.26.C04.1.454.CMB.2.raw
  modified_base (335)..(335): a, c, t, g, unknown or other
  modified_base (385)..(385): a, c, t, g, unknown or other
  modified_base (425)..(425): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacacggcccctggacaagggcttggagtggagtgggagggatcctcccgntctttggacaaaccacacctacgcacacaagtcccaggcagactcaacgnttaccgcggaacgaaatccacgagacacagtcacatgganatgagtgccgtgagatctgaccgacgacggccgttagttacttactgtcgacggacgaaggggcgggggaccgaagggggccgttacggggtagggttaacggttaagggtcgttacgttttggaagttcggtacggtcggggtaaccgg

SEQ ID NO: 378769 - DNA, 644 bp, Homo sapiens
  misc_feature: GZ8MTXP02JTN8T.38.26.C04.1.454.CMB.2.raw
  modified_base (364)..(364): a, c, t, g, unknown or other
  modified_base (478)..(478): a, c, t, g, unknown or other
  modified_base (510)..(510): a, c, t, g, unknown or other
  modified_base (560)..(560): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagccgtgggtccgtcggtagaacggtcccctgcgaaggtccttcgtggacggctaccgttcgagcctactactacttcacgcgtgggtcgacgacgaccggccccgtaggacgaagggcttggaggtggagtggggacggtactcccgtaccgtnttacgtttacggaacctaaaccgacacccgtacgactaacacgtacgtaccgagacagtacctacgacgtaactaccggcgaacaactccgaacgtacgacacgaagtacacgngttacggatacgtaggaacgtcgtacaggganaacttcgagacgaaccgcggtcgttgtagtttcgaggtcgaggaacgggnggggacggggaccgtagggggtacctggggttaacggtttaggtaaggttcgttagtttacgagtttagtcgggacggaaacgg

SEQ ID NO: 378770 - DNA, 694 bp, Homo sapiens
  misc_feature: GZ8MTXP02I1UVF.38.26.C04.1.454.CMB.2.raw
  modified_base (281)..(281): a, c, t, g, unknown or other
  modified_base (286)..(286): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaagcttctggaggcaccttcagcacctatactttcagctgggtncgacnggcccctggacagggcttgagtggagtggggaggctcccgtccgattcgtttacggaccaaaccacaccgtacgcaacaccaagttcccgaaggacagacctacaacgacgttacccggacggaaccgaaactcccgaacgacgacacagtacctaaccgagtacgggaagtagagtaggtacgaccgttaggaacgtagtaccgtacgaaacccggaccgaaccgggtccggttacgttaacgttttccgacgggttccggacgggaacgggacgggggaacggggggaccccggtaaggggggtccggttacgggggtttacggggtttaaaaccgggggtttaagggttcggtttaccggtttttaggacgtttacggttacgggttaccgggggtaaacccggg

SEQ ID NO: 378771 - DNA, 737 bp, Homo sapiens
  misc_feature: GZ8MTXP02I83R4.38.26.C04.1.454.CMB.2.raw
  modified_base (293)..(293): a, c, t, g, unknown or other
  modified_base (608)..(608): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgcctcctccgattcttggacaaaccacactacgcacacaacgttcaggacagactcacgataccgcgacgaatccacgagcacacgtctacagtggagatgagtcgcctagngatctagacgacgacggtcgtgttactttcgtggtcggacggtaggaaggggacgggggacccgtagggggtccgttacggggttacggggtttaaaacggtttggttagttaccgttttaggtaacgttacggttccgggggttaacgggggaacccgtaaagggggtaaacctaggttaccgggttacccgtaacccgttcccgtcccgttacgacccgtacccgtacccgaacccgaacccgggtcccctaccggtttccccgtcccgttcccccgtccgtacccctccccgtaccctacccgaacggaccnccgtaccgtccggtcggggaccacgcggcccggtcccgaggccgtccgtccgacggtacgaaacggtaccttacccgtaccgacgtacgtcgaccggtacgtcggtcggtaccggcggtacggaaccgg

SEQ ID NO: 378772 - DNA, 602 bp, Homo sapiens
  misc_feature: GZ8MTXP02GWYI0.38.26.C04.1.454.CMB.2.raw
  modified_base (270)..(270): a, c, t, g, unknown or other
  modified_base (285)..(285): a, c, t, g, unknown or other
  modified_base (422)..(422): a, c, t, g, unknown or other
  modified_base (492)..(492): a, c, t, g, unknown or other
  modified_base (577)..(577): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgattcttggcaaaccacactacgcacacaattccaggacagactcacgattaccgcggacaatccagagcacagtcctanagtgagatgagtacnctagagactcgagacgacacggtcgtgttattctgtgcggagagggtacggggcgaggggtcgtcggtaggttacggtagtgttacgtttgaattgtcggtacggggactaaggggactaagtcggtactacccgtntccgtacgacgtccacccaacggaccgccctagtccgtcccgtcccgtacgccctacccttcaaccgganaccgtcgaccgcggtgggacctacgccgccggtaccgtgggcctacgtccgtagaccgtaaacgctcgttaaccgcgttagaacncggacgtcgacggcgtacgacgacg

SEQ ID NO: 378773 - DNA, 584 bp, Homo sapiens
  misc_feature: GZ8MTXP02JGPR0.38.26.C04.1.454.CMB.2.raw
  modified_base (271)..(271): a, c, t, g, unknown or other
  modified_base (281)..(281): a, c, t, g, unknown or other
  modified_base (492)..(492): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggagcaccttcagcactatacttnagcgtgggtnacgacacggcccctaggacaaggcttgagtggatgggaggatccctcccgattcgtttggaccaaaccacaccctacgacacacaacgttccgagccagactcgaacgacttaccggacgacgaactcccaacgacgacacagtacctagacgtggagatgaagtacgcttacgagactcgtacgaccgacgacgaaccgttgtatttcgngtgacggagagggacggggtaccagggggcttacggggtggtaacggttaaggtacgttacgtttagacgtagttacgggacgggtaaccgg

SEQ ID NO: 378774 - DNA, 644 bp, Homo sapiens
  misc_feature: GZ8MTXP02G7918.38.26.C04.1.454.CMB.2.raw
  modified_base (488)..(488): a, c, t, g, unknown or other
  modified_base (532)..(532): a, c, t, g, unknown or other
  modified_base (538)..(538): a, c, t, g, unknown or other
  modified_base (546)..(546): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgctaggttggtgcagtcgtgggctggaggtagaagagccgtgggtcctggtagaacggtccctgcaggcttcgtggagccacctcagccactatacttcgagcgtgggtcgaccgaccgccggcccgtaggacgagggtcgtggaggtggaggtggggacggtacttccccgtacgtagttccgttacgaaccaaaccgacaacccgtaccgactaccgaacgtacgtaccgaagaccacgactaccgacgtaccgtaccggacgtaaccacgtacccgaacgacgtacacgtacgttacagtgtaagaancgaggtagtacgtagtagagtctaggacgaaccgctaccgggtntagttnttcggagnggaacggtgggcggggaccggggtcggtaggggtcgtacggggtagttaacgggttcggtgttaccgttaggacccgtggtaccggggagtaaacggg

SEQ ID NO: 378775 - DNA, 702 bp, Homo sapiens
  misc_feature: GZ8MTXP02H0VNZ.38.26.C04.1.454.CMB.2.raw
  modified_base (242)..(242): a, c, t, g, unknown or other
  modified_base (251)..(251): a, c, t, g, unknown or other
  modified_base (263)..(263): a, c, t, g, unknown or other
  modified_base (266)..(266): a, c, t, g, unknown or other
  modified_base (271)..(271): a, c, t, g, unknown or other
tcagtcgatcacgtcacgaccggtgctcgatttagtctagcgactttgggtttgggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagagctgggcgtggtgaagtccctgcagtcttcnggagcactnagcactatcttnagngtggncgacacggcccctggaacgagggtcgttggaggtggaagtggggagggtactcccgtccggtattccgtttacggacctaaaccgctaccctacgacaacgactaacgttacccgaaggacctacgtaacgtaccgacgttaacgttaccgacgtaaacgaacctccgaaacgacgacaaccgaggttactaacgagtggaagacgtagtaacgaacggctaagggctacgttacgacggaaccgtacgaacccgggggtcttacggttaacgttcgtacggtacggaccgggtaaggggtacgggggtaccgggggaccggtaaaccggggggtccgttaaccgggggtttaggttaaaccgggttaacggggttggttaaccggttttaggcgtttaaacgggtccggtttaaccgggggaaaccgggg

SEQ ID NO: 378776 - DNA, 678 bp, Homo sapiens
  misc_feature: GZ8MTXP02G78OT.38.26.C04.1.454.CMB.2.raw
  modified_base (245)..(245): a, c, t, g, unknown or other
  modified_base (275)..(275): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtccaggtgcagttggtgcagtctgggctgaggtgaagagctgggtcctcggtgaaggtccctgcaaggcttctggngcacttcagcacctatacttcagctgggtncgacacggcccctaggacaagggcttggagtggatgggacggatcccgccgattcttaggacaaaccacaccctacgactacaactaacgttacccaaggctacgacctacgacgaacttacccggaggaaacctaaacgtcccaaacgagacaaccagttactaacgatggggaaactagtacgtaagtacgtccgtagagtaactacggtagaaaccggtaccgacggggttcccgtgtttaacgtttccgttaaggcggaaaccgaaggggacgggggaacgggggtacccggaacggggggttccgtaccgggggttaaacgggttaaaccgggtttaagggttcgggttaacctttttaggggactttaacggtacgggtttaacgggggaaacccgg

SEQ ID NO: 378777 - DNA, 680 bp, Homo sapiens
  misc_feature: GZ8MTXP02IVQ51.38.26.C04.1.454.CMB.2.raw
  modified_base (254)..(254): a, c, t, g, unknown or other
  modified_base (376)..(376): a, c, t, g, unknown or other
  modified_base (633)..(633): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtagaagagccgtgggtcctcggtgaacggtcccctgcgaaggtcttcgngggacgcctaccgttcacgcaccttatactttcgagcgtggtcgacgacgacggcccctaggaacgaacgggtcttaggagtggagtggggaggactcccgtccgtattcgttgaccaaacncactacgcacacactaccagacagacacgacgtactaccggacgaacgaaactacccgaaacgacgaaccgtaacgaacgttacctaaaccgaagaggggaataacgaggtaaacgtacgccgtaagagtaactcgtacgaacgtaccgaccggtcgttaacggttacttcggacggtacggaccggagggtaacggggacgggggacccggtagggggttaccgtcggggttaacggttaacgggttaacgggttntttacgggtttacgagtttaacggtccgggtaacggggtaaacccgg

SEQ ID NO: 378778 - DNA, 699 bp, Homo sapiens
  misc_feature: GZ8MTXP02IH7N8.38.26.C04.1.454.CMB.2.raw
  modified_base (293)..(293): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctggaggtgaagagccgtgggtcctcggtgaacggtcccctgcaaggtcttcgtggacggctacccttgacgctacctatactttcagtctgggtncgacgacggcccctaggacgaggcttgaggtggagtggaggactcccgtccgtatccgttcggacctaaaccgctacctacgacaacgtaactaacgttaccgacgacgacaacgtaccgacgtaaccgttacccggacgggtaaacctaaccgccgaaccgtagacctaacgacgtacctacgagtggtaagtataggtaaagccgtaccgtagacgtacttacggacgaaccgaccgtaacgggttcccgttagttacgtttcgtagggttacggacgggtaaaagggaccgggggtacgggggaccggtacgggggttacgtaccgggggtttaaggttaaaccgggttggtacggtttacgtttaggtacgttacgggtttaccgggacggggtaaaccggg

SEQ ID NO: 378779 - DNA, 713 bp, Homo sapiens
  misc_feature: GZ8MTXP02G2E1H.38.26.C04.1.454.CMB.2.raw
  modified_base (291)..(291): a, c, t, g, unknown or other
  modified_base (325)..(325): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagcctgggtcctcggtgaacggtcccctgcgaaggtcttcgtggaggctaccttcagcacctatacttcagtctggtgcgacncggcccctaggacaggtcttggagtggagtgggnggactcccgtccgattcgttacgacaaaccatacccgtacgcaactacctacgttaccacgggtacacgtacctaccgaaccgtaacgttaacccggcgggaaacctaacgtcccgaaacggaccgacgtaaccgtacgtacctaacgtagtaacgggagtaagttcgggaaacgttaccgtaccgtaggtaacgtacgttacggtacgaaaccgtaccgtaccgggtaccgtttagttacgtttaccgtaggtacggtacgggaagggtacgggggaccggggtaccggtacgggggtaccggttaccggggtaaggtttaaacggggttccggttagtttacggttaggtaacgttacggtttaccggggtacggggtaaacccgg

SEQ ID NO: 378780 - DNA, 763 bp, Homo sapiens
  misc_feature: GZ8MTXP02G3GXA.38.26.C04.1.454.CMB.2.raw
  modified_base (270)..(270): a, c, t, g, unknown or other
  modified_base (306)..(306): a, c, t, g, unknown or other
  modified_base (313)..(313): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagagccgtgggtcctggtgacggtcccctgcagcttcgtggagcactcagcacctatacttnagtcgtggtgcgacacggcccctggacgaggctggngtggagnggaggctcctccgtattacgttacgaccaaaccgtacacccgtaccgacaacctaaccggtaacgttacccgaacgggacctaacgtacttaccgaaccgttacggttaaacccccggaccggggttaaaccaaaccgttacccgaaaaccggtacgacctaaacgtacggtttaacccaaacggagtaacggggtaaacgacgttaacggaacgttaccggacgttaagggacgtaaccgttaccgggacgaaacgacccggttaacccggtcgtttacgtttaaccgtttgtacggttacgggaccggtaagggtaaccgggggcgggggtaaacccgacgggggttccggttacggggttaacggggtttaaaacgggttcggggtttagtttaacggttttacggtacgtttaacggttacccggggttacgggggtaaacccggg

SEQ ID NO: 378781 - DNA, 651 bp, Homo sapiens
  misc_feature: GZ8MTXP02FH7WE.38.26.C04.1.454.CMB.2.raw
  modified_base (324)..(324): a, c, t, g, unknown or other
  modified_base (345)..(345): a, c, t, g, unknown or other
  modified_base (357)..(357): a, c, t, g, unknown or other
tcagtcgatcacgtcacgaccggtgctcgatttagtctagcgactttgggtttggggatggttttctcgatggggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcgacaatccacgagcacagtctacatggagatgagtagcctgagatctgacgacacggccgtgtatttctgtgcgagnggaggggccaggggtctcggnggtaacgttggngtcttttgattatcgtgggggacctaagggactaaatgggtccacccgtctccgtcacgcctacccaccgaacggcccacgtccggttccttcccccgtcgccgtaccccctcctaccccgaaacgtacgaccgacccgtaccgtcgggggcccaacggaacggtccggccccgtcggggtccgtcgggtcccgttagggttccgaaaacggggtaccttaacccgtttacccgaaacccggttcggtaacgtccggtaacgttcggtaacgggtcggggccgtcgggaccggg

SEQ ID NO: 378782 - DNA, 637 bp, Homo sapiens
  misc_feature: GZ8MTXP02II71U.38.26.C04.1.454.CMB.2.raw
  modified_base (248)..(248): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtgtggcagcagctacaggtgtccagtcccaggtgcagttggtgcagtctggggctgaggtgaagaagcctgggtcctcggtgaacggtcccctgcaaggcttcgnggaggcaccttcagcacctatacttcagctgggtgacgacacggcccctaggacaagggctttgagtcggagtggggaggacttcctccgaattcgttaggaccaaaaccgacaaccctacgacacgtaacaagttacccgaaggtccaagactaccgacgtaacttaccggacggtaacgaaactccgaacgaacgacaacagttacaacacgtaggacgatacgaagtagaccgttagaagtatacgtagacgaacgtacggcgttacgttaagttcctaggtacgacgaaggtacgacgggggtacgacggggtccgtacggtacgggttaaacgttaacgggttagtaccgttttaggaacttacggacggtttacgggaaaccg

SEQ ID NO: 378783 - DNA, 686 bp, Homo sapiens
  misc_feature: GZ8MTXP02INKFX.38.26.C04.1.454.CMB.2.raw
  modified_base (271)..(271): a, c, t, g, unknown or other
  modified_base (291)..(291): a, c, t, g, unknown or other
  modified_base (308)..(308): a, c, t, g, unknown or other
  modified_base (341)..(341): a, c, t, g, unknown or other
  modified_base (360)..(360): a, c, t, g, unknown or other
  modified_base (450)..(450): a, c, t, g, unknown or other
tcagtcgatcacgtcacgaccggtgctcgatttagtctagcgactttgggtttggggatggtttttctcgatgggggctgggagggctttgttggagaccttgcacttgtactccttgccattcagccagtcctggtgcaggacggtgaggacgctgaccacacggtacgtgctgttgtactgcctcctcccgattctttggaccaaaccacactacgcacaacaacgttccaggacagactcacgattaccggcgacgaactccacgganacactagtacacagtagganagtgagtacgcctgganatcgtagacgacgaccggtcgtagttactttgngtgcgaggaggcggggcgngggtcgtcggtggtacgttgtgttctttagattacgtcggggtacgggaacggtaaagggactaaggtcgtaccgtacccgttcctaccncctaacgcccccgtaccgaaacccggaccggccccttacggtcccgttcccccgttccccgcgccccacccccgttccaaacggacgcctaccggaccgttcggggaacggcaaccggtcggcccggtcccgtgggccgttcgcccggttagaacccgtaacgttaacccgtttccgtaccggagttacgtaaccggtcgaacggggttccgagggtcccggtacgggacgaaccg

SEQ ID NO: 378784 - DNA, 742 bp, Homo sapiens
  misc_feature: GZ8MTXP02IY2RT.38.26.C04.1.454.CMB.2.raw
  modified_base (249)..(249): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagccgtggtcctcggtagacggtcccctgcgaaggtcttcgnggagcctaccttcacgcaccttatacttcagtcgtgggtcgcgaccgtacggcccctaggacgaaggtcttaggagtggagtgggacggactcccgtcgtattccgttagacctaaaccgtacaacccgtacgaccaaccgtaaccgtaacgttacccgaacggacctaacgtacccttaccgaaccgttaacccgttaacccgggaccggggtaaacccaaaccgtacccggaaaccggtacgtaacccgaacgttaacgttacccgtaaaccgtaggttacgggaaacgtaagtaacgggtaacgtaaccgtccggttaaggacgtaactttaccggaacggtacccgaaccggttacggttaccgttaagtttcgttcggacgcggacgggaagggtaccggggacgggggtaccgaaggggtccggttacgggtagggtttaaacggtggttcgtttacgttaggacgttacggtcggacgggtaacgg

SEQ ID NO: 378785 - DNA, 631 bp, Homo sapiens
  misc_feature: GZ8MTXP02HVJ3J.38.26.C04.1.454.CMB.2.raw
  modified_base (327)..(327): a, c, t, g, unknown or other
  modified_base (547)..(547): a, c, t, g, unknown or other
tcagtcgatcacgtcacgaccggtgctcgatttagtctagcgactttgggtttggggatggtttttctcgatgggggctgggagggctttgttggagaccttgcacttgtactccttgccattcagccagtcctggtgcaggacggtgaggacgctgaccacacggtacgtgctgttgtactgctcctcccgattctttggacaaaccacactacgcacacaacgttcaggacagactcacgataccgcgacaatccacgagcacagtctacagtggacatgagtacgctagagtatcgtagacgacgacggtccgtgttatttcgngtgcgggaggaggacggggccgaaggggcgttacggggtacggttaacgtttaggtcgttacgttttgagttagtccgggtaagggggacctaaaagggtacctaagtcggtcctaccggtactcctcgacgcctaccgaaccgacggtcccacgttcccggtacctccccgtacgccctccccttaccaccgaagcgacctacccgtggcgggcaacgngcccggtacgcgggtcgcgtcgacggtacacggtaccttctaccgtacgacgaagtcgtacgcggacggccggtagacggaacg

SEQ ID NO: 378786 - DNA, 763 bp, Homo sapiens
  misc_feature: GZ8MTXP02I76H1.38.26.C04.1.454.CMB.2.raw
  modified_base (280)..(280): a, c, t, g, unknown or other
  modified_base (300)..(300): a, c, t, g, unknown or other
  modified_base (329)..(329): a, c, t, g, unknown or other
tcagtcgatcacgtcacgaccggtgctcgatttagtctagcgactttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgacgacgaactccacgagcacagtctacagtgganatgagtagcctagagatcgngaaccgacgacggccgttgtacttttcgngtgacggagagggacgggggaccgaggggtcgtccggggtaggttaaccggttagggtcgttcgtttttaggaacgttacgtcgggtacgggggaacccgaaaggggtaaaccctaaggttcgggtacccgtacccgttaccgtcccgttaccgaccgtaccccttacccgaaacccggtaaaccggggccccctaacggttccccgggttccccgtttaccccccgtcgggtaccccctacccccgttcccgtacccgtaaacgacccgaccccgtacccgttccggtcgggggacccaccgacggtcccgggccccgtcgggtcccgtacggtcccggtacgggttaccgaaaccgggttaaccttacccgttaaccgtaccgtttacgaacgttccgtacgtacggaccggcgggtacccgtggaaaccgg

SEQ ID NO: 378787 - DNA, 649 bp, Homo sapiens
  misc_feature: GZ8MTXP02HERMH.38.26.C04.1.454.CMB.2.raw
  modified_base (287)..(287): a, c, t, g, unknown or other
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctggaggtgaagaagcctgggtcctcggtgaacggtcccctgacaaggcttcgtggagcaccttcagccacctatacttcagcgtgggtnacgtaccacggcccctaggaccgtaagggccttggaagtggagtggggagggacttcccgtccgagttccgtttaggacctaaaaccgcaccgtaacgcctacaactaagttacccgaaggacacggaactccgaaaccgtacgttacccgacggtaaccgaactacccgacgagaccaacgtcgtactaaccgagtacgggactagtagaagttcgaccgtagtagtactcggtacgaccgtacgaccggtcgtgttaacttcgagtcgtacggaggtacggacgggggtcccaggggtcccgttacggggtgttaaacgggtgttcgtacgtttacgtttaacggtcggtacgggtaccg

SEQ ID NO: 378788 - DNA, 704 bp, Homo sapiens
  misc_feature: GZ8MTXP02HGS5G.38.26.C04.1.454.CMB.2.raw
  modified_base (385)..(385): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctggaggtgaagagccgtggtcctggtgaacgtccctgacaaggtcttcgtggacggcctaccttcagccactatactttcgagctgggtcgacgacgacggcccctaggaacgaaggggtctttggaagtgggaagttggggaacggtctacccgtcccggtattccgtttacggacctaaacctanaaccccgtaccgaccacacgaacgttccaagggacctacggaacctacgaccgtaacttacccgggacgggtaaacccaactcccgaacgtaacgccaactacgttacaaccgaagtcggaaaaggtgtacggtaacgtacgtacgtagacgtacgtacgacggaccgtaccggtacgttcgttagtttacgttcggtggacggacggacgggtacggggtacggggacggtacggggttccgttacggggtttaacggttaacggtttcggttacgtttacggtttacgtaacgttacgggtaccggtaacgggaacg

SEQ ID NO: 378789 - DNA, 626 bp, Homo sapiens
  misc_feature: GZ8MTXP02GCWRR.38.26.C04.1.454.CMB.2.raw
  modified_base (290)..(290): a, c, t, g, unknown or other
  modified_base (316)..(316): a, c, t, g, unknown or other
  modified_base (369)..(369): a, c, t, g, unknown or other
  modified_base (426)..(426): a, c, t, g, unknown or other
  modified_base (446)..(446): a, c, t, g, unknown or other
  modified_base (451)..(451): a, c, t, g, unknown or other
  modified_base (471)..(471): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagcctgggtcctcggtgaacggtcccctgcgaaggtcttcgtggaggccaccttcagctacctatacttcagcgtgggtncgacgacggcccctaggacgtaaggngttcgagtggagtggggacggtctcccgtccgtattcgttaggacctaaaccncaaccctacgacaacactacgtaccagacagactcgaacgtactacggcgaactacnccagacgacacagtacacanagaantaggacgtcgacctgaagtntacgtacgaaccgtaacgccggtcgttaacgttctttcgtcgtaggaacggtaggacgggtacgggggaccggtaaggggttccgtaacggggttacggttaacgggttaaggttcggttacgtttaggacgttacggttcggacgggggtaacg

SEQ ID NO: 378790 - DNA, 772 bp, Homo sapiens
  misc_feature: GZ8MTXP02GXNJ9.38.26.C04.1.454.CMB.2.raw
  modified_base (248)..(248): a, c, t, g, unknown or other
  modified_base (251)..(251): a, c, t, g, unknown or other
  modified_base (261)..(261): a, c, t, g, unknown or other
  modified_base (272)..(272): a, c, t, g, unknown or other
  modified_base (279)..(279): a, c, t, g, unknown or other
  modified_base (491)..(491): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttccttctttgtggtggcagcagctacaggtgtccagtcccaggtgcagttggtgcaggtcgtggggctgaggtgaagagcctgggtcctcggtgaacggtccctgcaggcttgnggngctctcagcnctatcttcagngtgggcncgacgcgcccgtaggacagggtctggaggtggaggtagggacggtactccccgtccgtagttcgttacggaccaaaccgacaccccgtacgaccaccgtacgtaaccgttacccgaagacccgaagtaccgtaccgtaaaccgtaccgttacccggacgggtaaaccgtaaaccgtcccgaaaccgagaaccgactaaccggtactaaccgngtaggggtaatacgtacggaagtacggtccgtaggtaacgtacgtccgttaacggaccgttaaaccggcccggttacgtttacggttacgtttacccgttagggaccgggtacgggaaaacgggggttccgggggtaaaccggggggccggttacgggggttacccgggtttaacgggggtttaccgggtttaaaacgggggttttaacggggttcggtttaaacgtttttacgggtaaaacgtttccgggtttaccggggggtacggtaaaacccggggg

SEQ ID NO: 378791 - DNA, 703 bp, Homo sapiens
  misc_feature: GZ8MTXP02IT43T.38.26.C04.1.454.CMB.2.raw
  modified_base (579)..(579): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaacgcctgggtcctggtgaacggtcccctgcaaggtcttcgtggaggcaccttcagcaccttatactttcagtcgtgggtcgcgtaaccgcggtccccctaggaaccgtaagggtctttaggaggtagggagtggggaaggtctcccgtccgtattcgtttcgaccaaaccacacctacgacacctactaacgtccaaggccagtaccacgtaacgtacgtaccgtacgggaaactacgtaccacggacgactaccgtagtaccgtacaggttaacggagaagtacgggtaaaggtacgtacccgtaggtaacgtacgtttcgaaccggtacggaacccgtaccggtccggttagtttacgttttacgggngtacggacggtaggggcggggtacgggggtacggtacggggttacggttacggggtttaacggttaacggtttgggttcgtttacggtttacgtacggttacggttacggggtaacgggaacgg

SEQ ID NO: 378792 - DNA, 707 bp, Homo sapiens
  misc_feature: GZ8MTXP02IN8L3.38.26.C04.1.454.CMB.2.raw
  modified_base (285)..(285): a, c, t, g, unknown or other
tcagtcgatcacgtcacgaccggtgctcgatttagtctagcgactttgggtttggggatggtttttctcgatgggggctgggagggctttgttggagacctttgcacttgtactccttgccattcagcccagtcctggtgcaggacggtgaggacgctgaccacacggtacgtgctgttgtactgctcctcccgattcttttggacaaaccacactacgcacacaagttccaggacagactcaacgattaccgcgacgaactccacgagcacagtctacagtganatgagtagctgagatcagacgacgacggtccgttgttatttcgtgtggacgaggagggacggggtccgaggggcgttcgggtaggttaacggttagtcgttgtttgaattcgtcgggtgggacgtaaagggacgtaagtcggtcctacccggttcctccgtacgaccgtccctaccgaacccggaacggcccctcgttcccggtcccttccccccgttgggaccccctacccccgttcccgtaacccgtaacgacccgttccgaaacccgttccgggacgggggaccaaccggcgggtccccggtccggtcgggtcccgttcgggacccgttacgggttaccggaaaccggttaccgttacccttaccgggactttacgaacgttccggacgttacggacgggtccgggcgacggggtaccg

SEQ ID NO: 378793 - DNA, 693 bp, Homo sapiens
  misc_feature: GZ8MTXP02IPATN.38.26.C04.1.454.CMB.2.raw
  modified_base (444)..(444): a, c, t, g, unknown or other
tcagtcgatcacgtcacgaccggtgctcgatttagtctagcgactttgggtttggggatcacataacaaccacattcctcctctaaaagaagcccctgggagcacagctcatcaccatggactggacctggaggttcctctttgtggtggcagcagctacaggtgtccagtcccaggtgcagttggtgcagtcgtggggctggaggtgaagagccgtggtcctggtgaacgtcccctgcgaaggtcttcgtggaggccaccttcagccaccttatacttcagtcgtgggtgcgacgacggtccccgtaggaccgaagggtcgttggagtggagtgggtagtcgtactcccgtcccgtattcgttacgaaccaaccgaccacctaccgaccacaacgtaacgttaccacggacacgacctacgaccgtacgtaccgacgaacacnccgaacgacgacctacgacgtacctaagtaacgtagggaacgtagtacggtacgtacggtacccgtaggaacgtacgttacgacgtaaccgacggtaccggtaccgttgttaccgttgtcggtacggtacgggaggacggggacgggggaccggtacgggggtaccggttacggggttaacggggttaaaccgggttgggtttacgttacggttttagtaacggtttacgggtacgggttaaccggggg

SEQ ID NO: 378794 - DNA, 636 bp, Homo sapiens
  misc_feature: GZ8MTXP02HSBDB.38.26.C04.1.454.CMB.2.raw
  modified_base (278)..(278): a, c, t, g, unknown or other
  modified_base (318)..(318): a, c, t, g, unknown or other
  modified_base (323)..(323): a, c, t, g, unknown or other
  modified_base (372)..(372): a, c, t, g, unknown or other
  modified_base (469)..(469): a, c, t, g, unknown or other
tcagtcgatcacgtcacgaccggtgctcgatttagtctagcgactttgggtttggggatggttttctcgatggggactgggagggctttgttggagaccttgcacttgtactccttgccattcagccagtcctggtgcaggacggtgaggacgctgaccacacggtacgtgctgttgtactgctcctcccgatctttggacaaaccacactacgcacacaagttccaggacagactcacgattaccgcggacaactcacgagcacagtctacatgganatgagtacgctgagatcagacacgcgcgttgttatttcgngtcgngagaggaggggccaggggctcgggtaggtacgttggtgtcttttgattntccggtgggaccaaagggtactaagtcggtacacccggtctacctcgacgccctccgaaacgtaccgggaccctacgtcccgggtcctttcccccgnggccctaaccccttcccgtaccaaacggctaccgtacccgtcggtccggggcaaccggcgcccggcccgtttagggcccgtcgtaccggttcggtaaccgaacgggtaccctaccgtttaccgaccgttagaacgttcgacgtcggacggccgggacgtcggaacgg

SEQ ID NO: 378795 - DNA, 575 bp, Homo sapiens
  misc_feature: GZ8MTXP02GQLK8.38.26.C04.1.454.CMB.2.raw
  modified_base (260)..(260): a, c, t, g, unknown or other
  modified_base (395)..(395): a, c, t, g, unknown or other
  modified_base (406)..(406): a, c, t, g, unknown or other
  modified_base (436)..(436): a, c, t, g, unknown or other
  modified_base (442)..(442): a, c, t, g, unknown or other
  modified_base (496)..(496): a, c, t, g, unknown or other
tcagtcgatcacgtcacgaccggtgctcgatttagtctagcgactttgggtttggggatcacataacaaccacattcctcctctaaagaagccccctgggagcacagctcatcaccatggactggacctggaggttcctctttgtggtggcagcagctacaggtgtccagtcccaggtgcagttggtgcagtctggggctggaggtgaagaagcctgggtcctggtgaaggtcccctgcaaggcttctggaggcaccttnagcactatactttcagcgtgggtgcgacacggccccgtaggacaagggccttggagtgggaatggggacggatccctacccgattcgttggaccaaaacctacacctacgaccacacaactccaggacagactanacgtataccgnggtacaacaccaagacactacagtaccaanagaganagtagagtacgcgtagagtactctagaccgtacgaccggtcttagttagttcgngtacgacggtaggacggggacgggtcgaacgggtctagggtagtaagtaagtgttacttagactacgtcgtacgggacg

SEQ ID NO: 378796 - DNA, 687 bp, Homo sapiens
  misc_feature: GZ8MTXP02I2SNQ.38.26.C04.1.454.CMB.2.raw
  modified_base (230)..(230): a, c, t, g, unknown or other
  modified_base (251)..(251): a, c, t, g, unknown or other
  modified_base (265)..(265): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagcgtggtctggtgacgtcccngacaggcttgtggagctactnagctactatacttnagcgtggtacgcgacgcggtcccctaggacgaggtcgttagaggtgaggtagggaggtactccgtcccgtagttccgttaggaaccctaaaccgctaaccccgtaccgacaaccgtaaccgtaacgtacccaaggtaccataccgtacgtaaccgtaacgtaacccggacggaaacgtaaccacccgaacgtacgaacaacgtacgttaccagaagtaggagtacgacgtacggtacgtaccgtaggacgtacttacggacgaccgaagtaccggtccgtttaggttactttacggtagttccggtacggaggggacgggtaacgggggaccgtagggggttccgtaaggggttaccggtaaaaggtttgggttacgtttacgttttaggacgtttacggtaccgggttacgggaaaccggg

SEQ ID NO: 378797 - DNA, 708 bp, Homo sapiens
  misc_feature: GZ8MTXP02GAUO4.38.26.C04.1.454.CMB.2.raw
  modified_base (186)..(186): a, c, t, g, unknown or other
  modified_base (245)..(245): a, c, t, g, unknown or other
  modified_base (256)..(256): a, c, t, g, unknown or other
tcagtcgatcacgtcacgaccggtgctcgatttagtctagcgactttgggtttgggatcacataacaaccacattcctcctctaaagaagccccttggagcacagctcatcaccatggactggacctggaggttcctctttgtggtggcagcagctacaggtgtccagtcccaggtgcagttggtncagtcgtgggctgagtgaagaagctggtcctcggtgaacggtccctgcaaggtcttcgnggagcaccttnagcaccttagtactttcagcgtggtcgacgtaccacggtcccctaggaacctagggctttaggagttggggagtggggtacggtactcccgtaccgtagtttccgttacggactaaactaccgacctaccgcaacgaacgtagtacccaggccagacctaccgacgacgttaccgaggtaccgaacgttcccaaacgacgacgtaacacgtacctagacgaggacgaagttgacggtacgtacccgtaggtaagtacccgttaggtaccggaacccgtaacggacccggttccgggtttacgttaactttcgttccgggtaagggtaccgacgggggttaaagggtccgggggacccgtagggggttaccgtaccgggggttacgtttaaaacggttgggttaaaccgttcgtttaaaggctttaaacggtcggtttacggggaaacccggg

SEQ ID NO: 378798 - DNA, 653 bp, Homo sapiens
  misc_feature: GZ8MTXP02JOIZT.38.26.C04.1.454.CMB.2.raw
  modified_base (246)..(246): a, c, t, g, unknown or other
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctgaggtgaagagcctgggtcctggtgaacgtcccctgcaggtcttcgnggagctacttcagcactatacttcgagtcgtgggtcgcgacgcggtcccctggacgtaagggtcttggaggtcggagtggggaggtacttcccgtcccgtattcgttcggaccaaaccgtcaccccgtacgacactactaagtcaggcacgactcagacgttaccgacggacgtaaactcacgacaccactagtacctaacgagtaggactagttacgaagtaccgacgtaggtacattcgaacggaccgtacgaccggggtcttacggttactttcgaggttcgaacgggtaggacgggggtacggggtccgggtaacgggggttccggtacggggttacggttaaccggggtttaagacggtttagtttacggtacgttaacggttcgggaacgggtaaacccgg

SEQ ID NO: 378799 - DNA, 638 bp, Homo sapiens
  misc_feature: GZ8MTXP01EDI5U.41.6.A06.1.454.CMB.2.raw
  modified_base (215)..(215): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttccngccacggcctctggaacgtactaccagttccacttacttataccatcaactgggtgcgccacggcccctggacaagggcttgagtggagtgggtggaatcactccctttcgttttggctcactcacctacgcacgagtaccccgttccggggacaagtaacttacgaaacgttacccggcggtaacaaacgtcccaacaggacacagtcctaccatgaacaagtgtaacgttctttagaaactccgacgactacgggtcccgttactaacttacgtgtcgacggaagtccgggttccccgtaaccccagtccttacgccaaggtcgggacttcccgttttggaacgtacggtcggttcggggggaccacgggggaaccccttgggttcccgtaagttcggttaccctaaccgttcgtaaccgg

SEQ ID NO: 378800 - DNA, 683 bp, Homo sapiens
  misc_feature: GZ8MTXP01BTSGF.41.6.A06.1.454.CMB.2.raw
  modified_base (550)..(550): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgcacggcctcgtggaacgtactaccagttcccacttacttataccatcaactggtgcgccacggcccctggacgaaggcttgagtggagtgggtggaatcactcccttgttttggctcactcacctacgcacgacgtacccgttccgggacagtaacttacgaaattacccgcgacaaacgtcccaacgagacacgacgtcctaccaatagaactaagttacgtaacgtttactttagaaaccttcccggaaccgtaccgaccgggtccccgttacttaaccgttacgtggtacggaccggtaacggtaaccgggttccccgttaaacccccgnggtaccccgttaccggacgtaaggtcggggtaaccgttcccgttttagggaacgtacggttcgggttacggggggcttaaccgggggtaacccctgggtaacctagttcgttcctaacccgttcgtaacccgg

SEQ ID NO: 378801 - DNA, 824 bp, Homo sapiens
  misc_feature: GZ8MTXP01C4W7E.41.6.A06.1.454.CMB.2.raw
  modified_base (691)..(691): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgcacggcctgtaggaatactaccagttccactacttataccatcaacgtgggtcgcgcccgacggcccctggacgaagggcttggaggtggagtgggtacggaatctacttcccctttcgtttttacggccttctaccgtccacccgttacgacctaccggacggtacccccgttacccggggggactaaacggtaaacgtttaaccggtaaaaccgtttaaccccgggaacccgggtaaaccgtaaaaccgggttacccccaaaccggtaaaccgggaaaccctaaaccgtaacggttaccccttacccgaaacgttacggaaacctaaaggttacggttaaacggtttttaccttttaacggaaaaccgttaccccggaaacgaacccggtaccgggtaccccggtttaaccttaaccgtttacggtacgttacgggaccgtaacggtacccgggttacccccgttaaaccccgnggtccccgttacggccgtaaacggtcgggtaaccgttccgtttagggacgttaacggtccgggttacggggggttcaacccggggttaacccgtgggtcttaacgttcggttaccctaaccgttcgtaacccg

SEQ ID NO: 378802 - DNA, 745 bp, Homo sapiens
  misc_feature: GZ8MTXP01AIZNK.41.6.A06.1.454.CMB.2.raw
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgcacggcctcgtaggaacgtactaccagttccacttacttataccatcaacgtgggtcgcgccgacggcccctggacaagggcttggaggtggagtgggtaggaatctacttccccttgtttttcggccttccgtacctccacctacgacgacggacgtacccgttcccgggggactaacggtaaacttaccggtaaacgtttaacccgggcggtaaacctaaacgggtacccaacgaaccggaaccacgtaacgttccctaccgaagttacggaaactaagttggttaaacgtttacgttttaacgaaaaccgttcccggaaccgaaccgtacccgggtacccgtttaccttaacgttacgttcggtacggtaccggtaacggtacccggttacccccggttaaacccccgtgtcccgtaccgacgttcggtaacggtacgttcggttaggacggttacggtcgggggttacggggccgttaccgggtaaccgtcggtaacttacgttcgaccctaaccgttcgtccg

SEQ ID NO: 378803 - DNA, 620 bp, Homo sapiens
  misc_feature: GZ8MTXP01BPYBI.41.6.A06.1.454.CMB.2.raw
  modified_base (369)..(369): a, c, t, g, unknown or other
  modified_base (423)..(423): a, c, t, g, unknown or other
  modified_base (509)..(509): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgccacggcctcgtggaagtacctaccagttccacttacttataccatcaactgggtgccgccacggcccctggacgaagggtcttggagtggagtgggtgatcatccttgttttcgctcactcacctacgcacgagtacccgttccgggganagtaacttacgaacttaccgcggacaacgtccacaacgacacacgtcctacatnactaatgtagtttcttagaactccgacgacacgtccgttactactaacgtggtcgaccggacggtaccggtccccggtaaaccccncgtccgtcgacgtagtcggtacgttccgttaggacgtacgttcgggttacgggggcgttaccggggtaacccttggtaacttacgttccgttaccctaaccgttcgtaacg

SEQ ID NO: 378804 - DNA, 653 bp, Homo sapiens
  misc_feature: GZ8MTXP01C0RKM.41.6.A06.1.454.CMB.2.raw
  modified_base (543)..(543): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttctgcacggcctcgtaggaacgtactaccagttcccaacttacttactaccatcaacgtgggtcgcgcccacggcccctggacgaagggtcttggagtggagtgggtggaatcactcccttgttttcgctcactcacctacgcacgcgtacccgttccggggactagtaacttacgaacttacccgcggaacaacgtccaacacgaacacacgtactacccagtacgaactaagttagtaacgtttacttaagaaacgtcccgaacgaccgaccggtacccgtacttaactacgtcggtcgacgtacggaccggttccccgtaaccccgngtcccgtcgaccaggtcggtcgttcccttttaggagttacgtccgggttagggggccttaccggggtaaccccgtggtctacgttccgacctaacccgttcgtaacccgg

SEQ ID NO: 378805 - DNA, 528 bp, Homo sapiens
  misc_feature: GZ8MTXP02IYV8V.41.6.A06.1.454.CMB.2.raw
  modified_base (317)..(317): a, c, t, g, unknown or other
  modified_base (475)..(475): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttcccactacttataccatcaactgggtgcgccaggcccctggacaagggcttgagtggatgggtggaatcatccctnttttggctcactcacctacgcacgagaccttccggggcagaattacgattaccgcggacaagtccacagacacagtctcatgacaatgattcttagaaatccgacgacacggccgtctactactgtgcgagcggtccgtacccagctacgcagtggancctttgagactcgtacgggggctaggggaaccctggtcagttgtcacctcacg

SEQ ID NO: 378806 - DNA, 524 bp, Homo sapiens
  misc_feature: GZ8MTXP02HZITQ.41.6.A06.1.454.CMB.2.raw
  modified_base (214)..(214): a, c, t, g, unknown or other
  modified_base (437)..(437): a, c, t, g, unknown or other
  modified_base (445)..(445): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttccngcacggcctctggaatactaccagttccactacttataccatcaactgggtgcgccaggcccctggacaaggcttgagtggatgggtggaatcatccctctttttggctcactcacctacgcacgagacctccggggcagaattacgattaccgcggacaagtccacagacacagtctccatgacaatgagttcttgaaatccgacgacacggcctcactacngtgcgagngtcccgtacccagcctcgcactgagcttcgtgatcgtcgggcgacggaaccgtcggtacgtattcgtcgtacctcgacg

SEQ ID NO: 378807 - DNA, 550 bp, Homo sapiens
  misc_feature: GZ8MTXP02IIRWM.41.6.A06.1.454.CMB.2.raw
  modified_base (314)..(314): a, c, t, g, unknown or other
  modified_base (393)..(393): a, c, t, g, unknown or other
  modified_base (471)..(471): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccacttacttataccatcaactggtgcgccaggcccctggacaaggcttgagtggatgggtgaatcatccctnttttggctcactcacctacgcacgagacccgtccggggacagaattacgacttaccgcggaacaagtccacacgacacngtctcatgacaatgtagttctttagaaactccgacgacacggtccgtctactagtgtacgcgagacgtcccgtacccngcctcgcagtcggacgtccttagacgacgtcggtcgggggacacggggaaccctggtactgtcgtaccaccttacgacg

SEQ ID NO: 378808 - DNA, 535 bp, Homo sapiens
  misc_feature: GZ8MTXP02GDW2H.41.6.A06.1.454.CMB.2.raw
  modified_base (372)..(372): a, c, t, g, unknown or other
  modified_base (435)..(435): a, c, t, g, unknown or other
  modified_base (481)..(481): a, c, t, g, unknown or other
  modified_base (531)..(531): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatgggtggaatcatccctctttttggctcactcacctacgcacgagacccttccggggcagaattacgattaccgngacaagtccacagacacagctccatgacaatgagttctttgaaactccgacgacacggccgtntactactgtgcgtagacggtccgtaccccagcctcgcaagtggacncctttgacgatccgtgggggcacggggaaccctggtacattcgtcacctnaccg

SEQ ID NO: 378809 - DNA, 599 bp, Homo sapiens
  misc_feature: GZ8MTXP02JZSO8.41.6.A06.1.454.CMB.2.raw
  modified_base (359)..(359): a, c, t, g, unknown or other
  modified_base (493)..(493): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggagtgggtggaatcatcccttcttttggctcactcacctacgcacgacgacccgttccggggnagaacttacgacttaccgcggacaacgtccacgacgacacacgtcctaccatcgaactaatgtattcttagaaactcccgaacgaccgacggccgtctacgtactggtacgacgacgacggtcccgtaccccgngaccgtcgcagtcggacgtcctttaggacgtactcgggtcgggggacctaacggggtaacccccgttgggttacctagtttccggtaccaacccgttcgtaacccg

SEQ ID NO: 378810 - DNA, 575 bp, Homo sapiens
  misc_feature: GZ8MTXP02FWQ2B.41.6.A06.1.454.CMB.2.raw
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactgggtgcgccaggcccctggacaaggcttgagtggatgggtggatcatccctcttttggctcactcacctacgcacgacgtacccgtccggggcagaattacgacttaccgcggacaacgtccacacgacacactctccatcgaacaatgtagttcttagaaactccgaacgacacggcctactactactgtgcgacgacggtcccgtacccagctacgctaagtcggacgtccgtttggaaacgtcgtcgggtcgggggccgtaacggggtaacccgttgggtacctagttcggtacctaccgtcgtaaccg

SEQ ID NO: 378811 - DNA, 643 bp, Homo sapiens
  misc_feature: GZ8MTXP02JKKEL.41.6.A06.1.454.CMB.2.raw
  modified_base (214)..(214): a, c, t, g, unknown or other
  modified_base (266)..(266): a, c, t, g, unknown or other
  modified_base (358)..(358): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttccngcacggcctctggaatactaccggttccactacttataccatcaactgggtncgccaggcccctggacaagggcttgagtggagtgggtgaatcactcccttcttttggctcactcacctacgcacgagaccgttccccggggnagaacttacgacttaccgcgacacgtccacacgacacagtcctaccgatcgaacaagtgtacgtttacttagaaaacttcccgaacgaccgacggtccgttactaacttacgtggtcgacggaagtaccggtaccccgtacccccgaggtcccttcggactaacgtcgggaacgttcccgtttaggaacggtacgttccgggtacgggggtaccgtaaccgggggtaaaccccgttggggttacctaacggtttcggtaccctacccgtacgtaccggttacccg

SEQ ID NO: 378812 - DNA, 633 bp, Homo sapiens
  misc_feature: GZ8MTXP02GT99X.41.6.A06.1.454.CMB.2.raw
  modified_base (205)..(205): a, c, t, g, unknown or other
  modified_base (215)..(215): a, c, t, g, unknown or other
  modified_base (274)..(274): a, c, t, g, unknown or other
  modified_base (310)..(310): a, c, t, g, unknown or other
  modified_base (323)..(323): a, c, t, g, unknown or other
tcagtctatactatcacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtnaccctttccngccacggcctcgtggaagtacctaccagttcccacttacttactaccatcaactgggtnccgccacggcccctggacaggcttgagtggatgggngatcactcccttnttttcggctcactcacctacgcacgagacccgtccgggacaagtaacttacgacttaccgcggaacaacgtccaacacgaacacgacgttaccaccaatacgaactaagttacgtagttttaccgttaagaaactcccggaaccgaccgtaaccgggtcccttactaaccgttaccgtggtacggcgaacggtaccggtaccccgtaacccgagtcctcgactagtcggactccgtttagacgtacgttcgggacggggaccgacggggtaacccgtgggtactacgttctaccgacccgttcgaacccg

SEQ ID NO: 378813 - DNA, 533 bp, Homo sapiens
  misc_feature: GZ8MTXP01BYE0N.44.70.G04.1.454.CMB.2.raw
  modified_base (200)..(200): a, c, t, g, unknown or other
  modified_base (312)..(312): a, c, t, g, unknown or other
  modified_base (359)..(359): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacaatctccagccaccctgtctttgtctccaggggaangccaccctctcctgcagggccagtcagagtgttaggaactacttagcctggtatcaacagacacctggccaggctcccaggctcctcatctatgatgcatccaatggggccncgggcatcccagccaggttcagtgcagtggtctgagacagaacttcnctctcaccatcagcgcctagagccggaagatttgctagtttattactgtcaacaccgttagcgacgtcgggtcctagggtactaggtttggaccgtaaggggacccaaggtcctgggacgctaacgaaacgacgtgttggctgcacatcctgtcttcacttccttcccgctaac

SEQ ID NO: 378814 - DNA, 575 bp, Homo sapiens
  misc_feature: GZ8MTXP01EA5J3.44.70.G04.1.454.CMB.2.raw
  modified_base (205)..(205): a, c, t, g, unknown or other
  modified_base (211)..(211): a, c, t, g, unknown or other
  modified_base (213)..(213): a, c, t, g, unknown or other
  modified_base (217)..(217): a, c, t, g, unknown or other
  modified_base (219)..(219): a, c, t, g, unknown or other
  modified_base (224)..(224): a, c, t, g, unknown or other
  modified_base (244)..(244): a, c, t, g, unknown or other
  modified_base (262)..(262): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (293)..(293): a, c, t, g, unknown or other
  modified_base (315)..(315): a, c, t, g, unknown or other
  modified_base (433)..(433): a, c, t, g, unknown or other
  modified_base (512)..(512): a, c, t, g, unknown or other
tcagacagtatatacacgaccggtgctcgatttagtgtagtgtgaagggaaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcgngtctcncnctcncnctcgngagtgtgtgtgtggcgcgcncccgcccgagacgcgagngngcncgctactctattgtaganagatatanatatatctctctgacgacacanctcaccgtcacgaacggaacgacctaaacccgaaaacccaaacggtgggttaccgttaacctaactacgtaccgaaaccgtacggtccgactggacgacacgagaccatattcttcgngtccaccttctacagtaccaaccaatagaccgaccggtagttccttcgtaacccgtaccgggcggaacggaaggtaccncggtacgaccgtcctcacgttcacgcctccaaccgaaacgggccgacctcgttccgtcccccg

SEQ ID NO: 378815 - DNA, 663 bp, Homo sapiens
  misc_feature: GZ8MTXP01B71NN.44.70.G04.1.454.CMB.2.raw
  modified_base (206)..(206): a, c, t, g, unknown or other
  modified_base (212)..(212): a, c, t, g, unknown or other
  modified_base (214)..(214): a, c, t, g, unknown or other
  modified_base (219)..(219): a, c, t, g, unknown or other
  modified_base (221)..(221): a, c, t, g, unknown or other
  modified_base (226)..(226): a, c, t, g, unknown or other
  modified_base (241)..(241): a, c, t, g, unknown or other
  modified_base (246)..(246): a, c, t, g, unknown or other
  modified_base (262)..(262): a, c, t, g, unknown or other
  modified_base (264)..(264): a, c, t, g, unknown or other
  modified_base (266)..(266): a, c, t, g, unknown or other
  modified_base (269)..(269): a, c, t, g, unknown or other
  modified_base (271)..(271): a, c, t, g, unknown or other
  modified_base (276)..(276): a, c, t, g, unknown or other
  modified_base (288)..(288): a, c, t, g, unknown or other
  modified_base (478)..(478): a, c, t, g, unknown or other
tcagacagtatatacacgaccggtgctcgatttagtgtagtgtgaagggaaaggggactcctgtgccccaccatggacacactttgctccacgctcctgctgctgaccatcccttcatggggcctgtcccagatcaccgtgaaagagtctggccctacattggtgaaaccccacacagaccctcacgctgacctgcaccgtctcgngtctcncncgtcncnctcgngagtgtgtgtgtggngcgcncccgccagaccgtcgngngngcncnctacnctacttgtaganacgacgtatagacgtatagtacttccttctcgtacgaccacgacgtcacgaccctcacgaacggaacgaaccgtaaccgaaaacccaaacggtggttacccgttacctaactacgtaccgaaaccgtacggtaccgtaccttggggacaacagcgaactactagttacttcgcgtcccaccttccttaancgtaaccgaacccaagtaagtcccgaaccgggtacgtttcccttccgtaaaccccgacgggtccgggaacgtaaaacggtccttaccggtcggttaccctaccgtcttaccgaacttccgaacccttccgtaaaccccgaaacgggccccggttaacccttccggtttccccggtttcccccccg

SEQ ID NO: 378816 - DNA, 679 bp, Homo sapiens
  misc_feature: GZ8MTXP01DE00U.44.70.G04.1.454.CMB.2.raw
  modified_base (303)..(303): a, c, t, g, unknown or other
  modified_base (347)..(347): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtgggagtccctgagactctcctgtgaagcctctggtatttagttcagtggtctggcatgcacgtgggtccnccaggcctccgaggcgaaggggccgagtggttgcagttaagcanatgatggaagttcagtaaaattattaatgacaagaccgtccggtaggaaacggggccctattccaacctatcctacccgaagaacgtaacctaaacgttccccgggaaaatgtttaggtacgttaacgtttagggggaaaactttggggttaccaacggtcccgttaggaacgtacggttaccggaacgggtaaccgttcggggtcctttacgttggtttaaactttaccggttggttacggtacgggaaggttaggtttccggggggaggttttaaggggtaaggtttaacggtttacggttacccgggggctaaccgttaagtccggggg

SEQ ID NO: 378817 - DNA, 534 bp, Homo sapiens
  misc_feature: GZ8MTXP01AX4HO.44.70.G04.1.454.CMB.2.raw
  modified_base (201)..(201): a, c, t, g, unknown or other
  modified_base (369)..(369): a, c, t, g, unknown or other
  modified_base (418)..(418): a, c, t, g, unknown or other
  modified_base (470)..(470): a, c, t, g, unknown or other
  modified_base (492)..(492): a, c, t, g, unknown or other
tcagacagtatatacacgaccggtgctcgatttagtgtagtgtgaagggaaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtntcaggcttctcactcgtcactcctggagagggcgttgtctggggtgcggcacgccccccggaaaggccctggagtggatcgcactcacttattggaatgacgatatacgatatagtccttctctgacgaccagactcacgcctcacgaaggacacgtaaccaaaaccnggtgtcctacattgaccaacgtgaccctgtggacacaggcacatattcngtgcccattccatcgaccacaatgaccacgggcttctcgaaccctgggcccngggaactccgaggtccacgtcncacttcacgcctccaaccacgggcccatccggttcttccccg

SEQ ID NO: 378818 - DNA, 517 bp, Homo sapiens
  misc_feature: GZ8MTXP01BKYUY.44.70.G04.1.454.CMB.2.raw
  modified_base (201)..(201): a, c, t, g, unknown or other
  modified_base (259)..(259): a, c, t, g, unknown or other
  modified_base (390)..(390): a, c, t, g, unknown or other
  modified_base (491)..(491): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacaatctccagccaccctgtctttgtctccaggggaaangccaccctctcctgcagggccagtcagagtgttaggaactacttagcctggtatcaanagacacctggccaggctcccaggctcctcatctatgatgcatccaatggggccgcgggcatcccagccaggttcagtggcaggtcggtctgagacagacttcaactctcacatcagcgctagagcggagtntttgctagtttattactgtcaacacgtagcgacgtggtctagtacgtagtttcggcgtagggaccaagtcgtggacgctaacaaacgacgtgttggctgcncatctgtcttcattccttccgctaac

SEQ ID NO: 378819 - DNA, 562 bp, Homo sapiens
  misc_feature: GZ8MTXP01CYQOR.44.70.G04.1.454.CMB.2.raw
  modified_base (199)..(199): a, c, t, g, unknown or other
  modified_base (533)..(533): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacaatctccagccaccctgtcttgtctccaggggaangccaccctctcctgcagggccagtcagagtgttaggaactacttagcctggtatcaacagacacctggccaggctcccaggctcctcatctatgatgcatccaagtacggggcccgcgggcactccccagccaggttcagtggcaggtcgggtctgagacagtaacttcaactctacaccatcgagcggcctagagaccggaagtatttgctagtttacttactgtacaactaccgtagccgacggtcggtaccgttaggttacgtaggtttcggaccgtaggggacccgaaggtcgtaggacgccgtaacgaaacgacgtgcggtactgaccncatctgtcttctacttccttcccgctaac

SEQ ID NO: 378820 - DNA, 550 bp, Homo sapiens
  misc_feature: GZ8MTXP01EVWLJ.44.70.G04.1.454.CMB.2.raw
  modified_base (365)..(365): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgcccccggaaaggccctggagtggatcgcactcacttattggatgacgatatacgatatagtcttctctgacgaccagactcacgcctcacgaaggacacgtaaccaaaacnggtgtccttacattgaccaacgtgaccctgtggacacaggcaacattatttctgtcgcccatttcattcgaccaacaatcgaccacgggtcttacgttcgaacccgtggggaccaggggaactccgaggtccaccgtctcattcacgcctccaaccgaacgggcccacgtccggttcctcccccg

SEQ ID NO: 378821 - DNA, 558 bp, Homo sapiens
  misc_feature: GZ8MTXP01E3YC1.44.70.G04.1.454.CMB.2.raw
  modified_base (262)..(262): a, c, t, g, unknown or other
  modified_base (299)..(299): a, c, t, g, unknown or other
  modified_base (334)..(334): a, c, t, g, unknown or other
  modified_base (338)..(338): a, c, t, g, unknown or other
  modified_base (361)..(361): a, c, t, g, unknown or other
  modified_base (495)..(495): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggagtccctgagactctctgtgaagcctntggatttagttcagtggtctggcatgcacgtggtccncaggctccgaggcaaggggcgagtggtgcagttangcanatgatggaattcagaaattattngacagactcgtagaacgggccattcacatctacagacacaattacccggaatacgttgtagtacgttaggggaaattggtacaagcctaggacgtagtcggaaggtaccgtcgggcttcgtaagtactttacgngttgacggagagttcggggagggttggtagttaaggttacgtaccggggctcgttaagtcggg

SEQ ID NO: 378822 - DNA, 546 bp, Homo sapiens
  misc_feature: GZ8MTXP01DHIU2.44.70.G04.1.454.CMB.2.raw
  modified_base (301)..(301): a, c, t, g, unknown or other
  modified_base (340)..(340): a, c, t, g, unknown or other
  modified_base (412)..(412): a, c, t, g, unknown or other
  modified_base (535)..(535): a, c, t, g, unknown or other
  modified_base (540)..(540): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagcctgggaggtccctgagactctcctgtgaagcctctggatttagttcagtggtctggcatgcactgggtccnccaggctccaggcaagggggccgagtggttggcagttanagcacatgatggaagtttcagaaattattaatgcaagactccgtgaacgggccgattcaccatctaccaganacaattccccggaatattgtagtacttggggaaattggtacagcctgagagtcgaggtactcggctcgtgtattacgtgttgcgagagttcggggaaggtgggtaagtgttacgttaccgggngtcgngtcggg

SEQ ID NO: 378823 - DNA, 617 bp, Homo sapiens
  misc_feature: GZ8MTXP01B3VHU.44.70.G04.1.454.CMB.2.raw
  modified_base (264)..(264): a, c, t, g, unknown or other
  modified_base (304)..(304): a, c, t, g, unknown or other
  modified_base (340)..(340): a, c, t, g, unknown or other
  modified_base (345)..(345): a, c, t, g, unknown or other
  modified_base (369)..(369): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcacctggtggagtcgtgggggagcgtggtccagcctggggagtccctgagctctcctgtgaagcctntggtatttagttcagttggtctggcatgcacgtgggtccncaggctccgaggcgaaggggccgagtggtgcagtanagcanatgatggaattcagaaaattattntgacagtactccggtaggaaacgggcctattcacctatctaccaagacgactaacttccccggaaatagttgtagttaacgttaggggaaaattcgggtacaacggtccgtaggaacggtacggtaccggaagggtaccgttcgggtcttcgttaagttaatttacgtggttcggacggaggttaggttcggggttaggttaaggttaggttaaggtttacgtaccggggctaacgttaagtaacggg

SEQ ID NO: 378824 - DNA, 618 bp, Homo sapiens
  misc_feature: GZ8MTXP01A2EEA.44.70.G04.1.454.CMB.2.raw
  modified_base (283)..(283): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactccgtggagagggtcgttgtcgtggggtgccggcaccgccccctaggaacggccgtggagnggatcgcactctacttagtggaatgacgtatatacgatatagtccttctctagacgaccagactcaccgctacgaacgaacgaccaaaccgtaaccaaacgtggtcgtaccttacacgttacgaccgtaacgtcgacccgtggtacggacacgacgacactattactttcgcgtcgaccctacttcatcgaaccacgtaactccgaaccgtacgggtccttccgttacccggaacccgtcggggacccaagggtaacttccgtacgttccgtaccgtcttcgacttccgaacgtccctaaccgaccgaccgggccctaacgttcccggttccccg

SEQ ID NO: 378825 - DNA, 524 bp, Homo sapiens
  misc_feature: GZ8MTXP01ASIX6.44.70.G04.1.454.CMB.2.raw
  modified_base (491)..(491): a, c, t, g, unknown or other
  modified_base (495)..(495): a, c, t, g, unknown or other
tcagacagtatatacacgaccggtgctcgatttagtgtagtgtgaagggaaaggggactcctgtgccccaccatggacacactttgctccacgctcctgctgctgaccatcccttcatgtggcctgtcccagatcaccgtgaaagagtctggccctacattggtgaaacccacacagaccctcacgctgacctgcaccgtctcaggcttctcactcgtcactcctggagagggcgttgtctggggtgcggcagccccccggaaaggccctggagtggatcgcactcacttattggaatgacgatatacgatatagtccttctctgacgaccagactcaccgctcacgaaggacaacgtccaaaccaggtggtccttacattgaccaacgtggaccctgtggacacaggcacatattctgtgcccattcatgaccacaatgaccacgggcttcttcgaaccctggggccaagggaattccaggttcaccgtnttcnttcaagcctcacacggccaagttcgtccc

SEQ ID NO: 378826 - DNA, 554 bp, Homo sapiens
  misc_feature: GZ8MTXP01AM1VF.44.70.G04.1.454.CMB.2.raw
  modified_base (263)..(263): a, c, t, g, unknown or other
  modified_base (302)..(302): a, c, t, g, unknown or other
  modified_base (344)..(344): a, c, t, g, unknown or other
  modified_base (376)..(376): a, c, t, g, unknown or other
  modified_base (424)..(424): a, c, t, g, unknown or other
  modified_base (471)..(471): a, c, t, g, unknown or other
  modified_base (542)..(542): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggaggtccctgagactctcctgtgaagcctntggtatttagttcagtggtctggcatgcacgtgggtccncaggctccgaggcgaagggggccgagtggttggctaggttanagcaacatcgatggaattctagaaaattattngcagactcgtagaagggcccattcaccatctcagagacaatcccgaanattgatactggggaaatggtcagcctgacgagtcgagtcgtcggctntgtacttcgtgttcgcgtaaggttacgttcgggggaggttgggtaagttaacggttacgtacccgggggcncgttaagtcggg

SEQ ID NO: 378827 - DNA, 584 bp, Homo sapiens
  misc_feature: GZ8MTXP01CR1Y0.44.70.G04.1.454.CMB.2.raw
  modified_base (296)..(296): a, c, t, g, unknown or other
  modified_base (312)..(312): a, c, t, g, unknown or other
  modified_base (319)..(319): a, c, t, g, unknown or other
  modified_base (350)..(350): a, c, t, g, unknown or other
  modified_base (355)..(355): a, c, t, g, unknown or other
  modified_base (366)..(366): a, c, t, g, unknown or other
  modified_base (377)..(377): a, c, t, g, unknown or other
  modified_base (402)..(402): a, c, t, g, unknown or other
  modified_base (405)..(405): a, c, t, g, unknown or other
  modified_base (408)..(408): a, c, t, g, unknown or other
  modified_base (501)..(501): a, c, t, g, unknown or other
  modified_base (565)..(565): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcaccgtggtggagtcgtgggggaggcgtggtccagccgtgggacgtccctgacgactctcctagtaaacgccttcgtgtattttagttcagttggttcnggcatgcacgtggccncaggccncgaggcgaagggggccgagtggtgcagttanagcantgatggaattnagaataattangacagacgtcgagacggctatcacntcncanagactacgtaccgaatgttgagttacgttaggaaagttcggtacaacgtccgtaggagagtacgaaggtcctcggtctcgttgtaaacttcgnggtcgaggtaaaggtggttacgggggttggttagggttaaagttaggttaaccggtaccggggnacgtaaggttcggaacggg

SEQ ID NO: 378828 - DNA, 559 bp, Homo sapiens
  misc_feature: GZ8MTXP01EWRE2.44.70.G04.1.454.CMB.2.raw
  modified_base (305)..(305): a, c, t, g, unknown or other
  modified_base (344)..(344): a, c, t, g, unknown or other
  modified_base (348)..(348): a, c, t, g, unknown or other
  modified_base (369)..(369): a, c, t, g, unknown or other
  modified_base (451)..(451): a, c, t, g, unknown or other
  modified_base (501)..(501): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggagtccctgagactctcctgtgaagtcctcgtggtatttagttcagtggtctggctatgcacgtggtcccncgaggcctcgagggcaagggggccgagtggtgctagtangcanatgatggaatcagtaaatatngcagctcgtgaacgggcatcacatcacagagactaatcccggaatgttcgtatacgtagggaaattggtcagtccgtgaagnggtacgaggtcctcggtcttcgtaagtacttagtggttacgcggtaaggnggttcgggggaggttgggtaagttaacgttaacggtccggggctaacgttaagtcggg

SEQ ID NO: 378829 - DNA, 589 bp, Homo sapiens
  misc_feature: GZ8MTXP01DQY0A.44.70.G04.1.454.CMB.2.raw
  modified_base (147)..(147): a, c, t, g, unknown or other
  modified_base (174)..(174): a, c, t, g, unknown or other
  modified_base (212)..(212): a, c, t, g, unknown or other
  modified_base (248)..(248): a, c, t, g, unknown or other
  modified_base (322)..(322): a, c, t, g, unknown or other
  modified_base (429)..(429): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagngtctggccctacattggtgaaacccanacagaccctcacgctgacctgcaccgtctcaggcttcncactcgtcactccgtggagagggcttgtctggggtncgggcacggcccccggaaggccctggagtggatcgcactcacttatggaatgacgatatacgatatagtccttntctgacgacagactcacgctacaactaaggacaacgtaaacccaaaacgtggtcgtacctacatacgactaacgtcgaccctgtacggacagagcactattacttcngtcaccctacttcatcgaaccacaagtcgaacccgtacgggtcctttacgttccggaaacccgtgggggaccctaaggggaaactccggaagggtccacgtctacacgttccacggccctaccaaccgaacgggcccttagtcccggttcccttccccgg

SEQ ID NO: 378830 - DNA, 604 bp, Homo sapiens
  misc_feature: GZ8MTXP01C13BE.44.70.G04.1.454.CMB.2.raw
  modified_base (198)..(198): a, c, t, g, unknown or other
  modified_base (266)..(266): a, c, t, g, unknown or other
  modified_base (307)..(307): a, c, t, g, unknown or other
  modified_base (347)..(347): a, c, t, g, unknown or other
  modified_base (352)..(352): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggtttttcctcgttgcttcttttaagaggtgtccactgtcaggtncacctggtggagtcgtgggggagcgtggtccagccgtgggagtccctgagactctcctgtgaagcctntggtatttagttcagttggtctggcatgcacgtcgggtccncaggctccgaggcgaagggggccgaggtggttgcagttanagcanagtcgagtggtattctagtaaaattattaatgactagtactccggtagaacgggccctaattccactatcaccgagagtacctaacgttcccggaatagttgtacgttaacttaggggaaacttgggtactacggccttaggacgtacggtaccgaaggtccttcgggcctttgtggtttaattacggtgttgacgaggttcgttggggttaggttggtaagttaacggttacgtacgggctcgaagtcggg

SEQ ID NO: 378831 - DNA, 614 bp, Homo sapiens
  misc_feature: GZ8MTXP01BF29H.44.70.G04.1.454.CMB.2.raw
  modified_base (262)..(262): a, c, t, g, unknown or other
  modified_base (291)..(291): a, c, t, g, unknown or other
  modified_base (363)..(363): a, c, t, g, unknown or other
  modified_base (429)..(429): a, c, t, g, unknown or other
  modified_base (432)..(432): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgcttctttaagaggtgtccactgtcaggtgcaccgtggtggagtcgtgggggagcgtggtccagccgtgggagtccctgagactctcctagtaacncctcgtggtatttagttcaggttggttcnggctatgctacgtcggtcccgccgaggcctcccggaggcggaaagggggccggagttgggtggctaggttanagcacagtgactggtaaattctagaattaattatgacagactccgtaggaacgggcctatcacctntcncagacgactaacgttaccgaactattgtacgttaagttagggaaacgtggtacacgtcgtaggagtacgtacgaacggtctcgggcttacgtgttaattcgttggtagcgaaggtgttaccgggggttggttagggtaagttaacgttcggtacccggggtcacgtaagttcggtaacgggg

SEQ ID NO: 378832 - DNA, 633 bp, Homo sapiens
  misc_feature: GZ8MTXP01B6MP0.44.70.G04.1.454.CMB.2.raw
  modified_base (263)..(263): a, c, t, g, unknown or other
  modified_base (302)..(302): a, c, t, g, unknown or other
  modified_base (338)..(338): a, c, t, g, unknown or other
  modified_base (371)..(371): a, c, t, g, unknown or other
  modified_base (552)..(552): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgctcttttaagaggtgtccactgtcaggtgcacctggtggagtcgtgggggaggcgtggtccagcctgggagtccctgagactctcctgtgagcctntggtatttagttcaggtggtctggcatgcacgtgggccncaggctcgaggcgagggggcgagtggtgctagttangcacatgatggtaattcagtaaaattagttaangacagtactccggtaggaacgggcctattaccactagtcctaccgaagaacgtactaaacgttaccggaaactgtttcggtagttaccgttaggggtaaaacgttcggttaccacggtaccgtaggtaaggacgttaccgggaacggtaccgtcggtacttcttaaggttaactttacggnggttcgacggtaaggttagggttcggggttagggttaaggttaggttaacggttacggtaccgggcgtaacgttaaggtgg

SEQ ID NO: 378833 - DNA, 624 bp, Homo sapiens
  misc_feature: GZ8MTXP01BMTTG.44.70.G04.1.454.CMB.2.raw
  modified_base (264)..(264): a, c, t, g, unknown or other
  modified_base (304)..(304): a, c, t, g, unknown or other
  modified_base (342)..(342): a, c, t, g, unknown or other
  modified_base (346)..(346): a, c, t, g, unknown or other
  modified_base (370)..(370): a, c, t, g, unknown or other
  modified_base (607)..(607): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcaccgtggtggagtcgtgggggagcgtggtccagccgtgggagtccctgagctctctgtgaagcctntggtatttagttcagtggtctggcatgcacgtcgggtccncaggctccgaggcgaagggggcgagtggtgctagttangcanatgatggaattctagaaattattngacagtactcggtagaacgggcctattcacctatcctaccgagacgaacctaacgttaccccgggaatagtttgtagttaccgttaggggaaattcggggtacacggtcccgtaggaacgtacggttacggacggtaccgtccggtcttacgttgttaactttacgtggttcggaccggtaaggttacgggttcgggggttagggttgggttagttaacggttacgggtacccgggntaacgttaaggtcgggg

SEQ ID NO: 378834 - DNA, 639 bp, Homo sapiens
  misc_feature: GZ8MTXP01BZNCX.44.70.G04.1.454.CMB.2.raw
  modified_base (300)..(300): a, c, t, g, unknown or other
  modified_base (342)..(342): a, c, t, g, unknown or other
  modified_base (374)..(374): a, c, t, g, unknown or other
  modified_base (439)..(439): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagttcagtggtctggcatgcactgggtccnccaggctccgaggcaagggggccggagtgggttggcagttangcacatcgatggaagttctagaaattattaangccagacctccggtgaaacgggccgattcaccatcctccaagacgactaactttccccgggaaanagtttggtagttaacgtttaggggggaaaactttggggtaccagggtcccttaggaacggtaggttacccgggaacgggtaccttcgggggcctttactgggttaactttaccgtgggttcggaccggaggttaggttcgggggttaggtggggttaggtaagggtttacgttacccgggggcgtccgaaggttaacggg

SEQ ID NO: 378835 - DNA, 606 bp, Homo sapiens
  misc_feature: GZ8MTXP01CMR5S.44.70.G04.1.454.CMB.2.raw
  modified_base (302)..(302): a, c, t, g, unknown or other
  modified_base (343)..(343): a, c, t, g, unknown or other
  modified_base (596)..(596): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgcttcttttaagaggtgtccactgtcaggtgcacctggtggagtcgtgggggagcgtggtccagcctgggagtccctgagactctcctgtgaagcctctggtatttagttcagtggtctggcatgcacgtgggtccnccaggcctccgaggcaagggggccgagtggttggcagttanagcacatgatggaattctagtaaaattattaatgacagtacctccggtaggaaacgggcctaattccaacctatcctaccaagacgaacctaacgttccccggaaattagttacgtagttaacgtttagggggaaaagttgggttaccaaggtcccgttaggaggtacgtaccggaggtacctcggaccttcgtgttattcgtgttgcgagttcggttggggaggttggtagttaacggttacgtaccggggntcgaagtcgg

SEQ ID NO: 378836 - DNA, 617 bp, Homo sapiens
  misc_feature: GZ8MTXP01DVHIM.44.70.G04.1.454.CMB.2.raw
  modified_base (264)..(264): a, c, t, g, unknown or other
  modified_base (286)..(286): a, c, t, g, unknown or other
  modified_base (305)..(305): a, c, t, g, unknown or other
  modified_base (391)..(391): a, c, t, g, unknown or other
  modified_base (604)..(604): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggaggtccctgagactctcctgtgaagcctntggtatttagttcagttggtcnggcatgcacgtcgggtccnccgaggcctccgagggccaagggggccgaggtggttggctagttatagcacagttgagttaggaattctagtaaaattatttaagngactaaggtacctccgggtaggaaacgggtcctaattccgactatctaccagaacgactaacgttcccgaatacgttgtagtacgttaggggaaattggacagcctaggacgtagtacggaggtacctcggtcttcgtaagttacttacgtgttgacggtagttaaggttcggggaaggttggttaaaaggttcgtttaacggtacccggggntcgttaaggtcgg

SEQ ID NO: 378837 - DNA, 588 bp, Homo sapiens
  misc_feature: GZ8MTXP01A6NY3.44.70.G04.1.454.CMB.2.raw
  modified_base (266)..(266): a, c, t, g, unknown or other
  modified_base (306)..(306): a, c, t, g, unknown or other
  modified_base (353)..(353): a, c, t, g, unknown or other
  modified_base (388)..(388): a, c, t, g, unknown or other
  modified_base (528)..(528): a, c, t, g, unknown or other
  modified_base (579)..(579): a, c, t, g, unknown or other
  modified_base (583)..(583): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtggggacgtccctgagactctcctgtgaagcctntggtatttagttcagtggtctggcatgcacgtcgggtccnccaggcctccgagggcgaagggggccggaggtggttggctaggttanagcacagtcgatgggaagtttcagtaaaattattnggcagtacctccggtaggaaacgggcccattccaccatccgaccagtaacgacctaagttccccggaaatgttgtagtacttaggggaaatggacagcctgagagtcggaggtacctcgggacttcgtaaggttattcgngttgaccggtagttagttcgggggagttggtaagtgttacggtacccgggntcgngtcgg

SEQ ID NO: 378838 - DNA, 603 bp, Homo sapiens
  misc_feature: GZ8MTXP01BZ2IC.44.70.G04.1.454.CMB.2.raw
  modified_base (147)..(147): a, c, t, g, unknown or other
  modified_base (212)..(212): a, c, t, g, unknown or other
  modified_base (231)..(231): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagngtctggccctacattggtgaaacccacacagaccctcacgctgacctgcaccgtctcaggcttcncactcgtcactcctggagngggcttgtctgggtgcggccacgcccccggaaggccctggagtggatcgcactcacttagttggaatgacgatatacgatatagtccttctctcgacgtaccagactcacgcctacaactaacggaccacgtaaacccaaaacctggtacgtaccttacacttacgaaccgtaacgtcggaccctggtacggacacgaggacctaactattactttctggtcctccctacttcatacgaacccaactaaacgtcgaacccgtacgggtccttacgtaccgtaacccgtggggacccagggaactccgaggtccacgtctcagttccacgtccctccgaaccgtacggcccttacgtcccgttccttccccgg

SEQ ID NO: 378839 - DNA, 663 bp, Homo sapiens
  misc_feature: GZ8MTXP01BCK8S.44.70.G04.1.454.CMB.2.raw
  modified_base (266)..(266): a, c, t, g, unknown or other
  modified_base (307)..(307): a, c, t, g, unknown or other
  modified_base (350)..(350): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcactggtggagtcgtggggagcgtggtccaggccgtgggacgtccctgagactctcctgtgacgccttntggtatttagttcagttggtctggcatgcacgtgggtcccncacggcctccgaggcgaagggggccgtaggtggtggctagtanagcacgagtgagtaggtaagttctaggtaaaattattgcgacgaagtaccgtccggtagggaacgggtcctacttcaacctatccgaccgaagaacgtaacctaaacttccccgggaaattcgttggttacgttaaccggttaaggggaaacttggggtccaacggtccgtaggaacgtaggttaccgaacgggtacccgttcggtcctttcgtaagttaaaccgtttcgtgggttccggaagttagggttacggttgggggagtttgggttaacgttaaggttaccggtccgggggatcgttaagtccgggg

SEQ ID NO: 378840 - DNA, 682 bp, Homo sapiens
  misc_feature: GZ8MTXP01CS3OR.44.70.G04.1.454.CMB.2.raw
  modified_base (282)..(282): a, c, t, g, unknown or other
  modified_base (496)..(496): a, c, t, g, unknown or other
tcagacagtatatacacgaccggtgctcgatttagtgtagtgtgaaggggaaagggggactcctgtgccccaccatggacacactttgctccacgctcctgctgctgaccatcccttcatggggcctgtcccagatcaccgtgaaagagtctggccctacattggtacgaaacccacacagaccctcacgctgacctgcaccgtctcaggcttctcactcgtcactccgtggagagggtcgttgtcgtgggtgcggcacgccccgtagaacggccgtggagnggatcgcactctacttagtaggaatgacgtataatacgtattatacgttcctttctcgtacgacaccaacgactacacccgtactacgacggaaacgaaccctaaaccgtaaacccaaaccgtagggttaccgggttacccttaacgtacttacggaaacccgtaaacgggtacggtaccctagggtacggacacgacggactactattattcncgtcgaccctactcaacgtcaaaccactaacgtccgaccgtcgggttaccttaccgttacccgaacccggttcgggaccgaacgggtaacacccggtaacggttccgtaacccgtcttaccgttcttacccgaacgtcccctaaccgaaccggaccgggttaccctaacggttcccgtttcccccg

SEQ ID NO: 378841 - DNA, 601 bp, Homo sapiens
  misc_feature: GZ8MTXP01CCYMU.44.70.G04.1.454.CMB.2.raw
  modified_base (263)..(263): a, c, t, g, unknown or other
  modified_base (304)..(304): a, c, t, g, unknown or other
  modified_base (351)..(351): a, c, t, g, unknown or other
  modified_base (391)..(391): a, c, t, g, unknown or other
  modified_base (549)..(549): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgctcttttaagaggtgtccactgtcaggtgcaccgtggtggagtcgtgggggagcgtggtccagccgtgggagtccctgagctctcctgtgagcctntggtatttgttcagttggtctggcatgctacgtgggtcccncgaggcctccgagggcgaagggggccggtaggtggttggctagttanaggcagagtcgatggtaatttcgtagtaaaattatttaangacagactccggtaggaaacgggccctaattcaacctatcctaccgaagtaacgacctaacgttccccggaaattagttcgtacgttaacgttaggggaaacttgggtacacgtcctagagtaggtcgaggtcctcggccttgtaagttacttcgtgngcgagttacggttggggagttggtagttgttacgacgggctaagaaggtcgg

SEQ ID NO: 378842 - DNA, 691 bp, Homo sapiens
  misc_feature: GZ8MTXP01BHVPS.44.70.G04.1.454.CMB.2.raw
  modified_base (265)..(265): a, c, t, g, unknown or other
  modified_base (300)..(300): a, c, t, g, unknown or other
  modified_base (342)..(342): a, c, t, g, unknown or other
  modified_base (381)..(381): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcaccgtggtggagtcgtgggggaggcgtggtccagccgtgggacggtccctgagactctctgtgagcctntggtattgttcagtgtctggcatgcactgggtccncaggctccgaggcgaagggggccgtaggtggtggctagttanagcacatcgataggtaagttctagtaaaattacttaagngactaagaccgtccggtaggaacgggtaccgtacttaccaacctactacctaccgaaaggtaacgaaactaacgttaccccggaaacttacgttaggttacgttaacggttaggggtaaaacgttcggggtacacggtacccgttggaacggtacggtaccgggtaaacgggtccgttaccggtcccgtttgtaacggtttaatttaaccgttgggttaccggacgggtaaggttaggggttacgggggaaacggttcggggaccgtaaggactacgggttacctttaaggtttaacggtttcccggggg

SEQ ID NO: 378843 - DNA, 668 bp, Homo sapiens
  misc_feature: GZ8MTXP01B42HJ.44.70.G04.1.454.CMB.2.raw
  modified_base (306)..(306): a, c, t, g, unknown or other
  modified_base (349)..(349): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcaccgtggtggagtcgtgggggagcgtggtccagccgtgggagtccctgagactctcctgtgacgcctctggtatttagttcagtgtctggcatgcacgtcgggtcccncgaggcctccgagggcgaagggggccgagtggttgctagttanagcacatcgatggaattctagaaaattattgtgacagtacctccggtagggaaacggggtccctattccaacctacgtcctaccgaagtaacgaactaacgttaccccggaaatagttagtagttaacgttaggggaaaacgttgggtccaacggtcccgtaggaacggtacggttaccgggaacggtaccggttccggtcctttcgttaaggttaactttacgtcggttggacggtaaggttacggttgggggttagtttaagggggttagtttaacggtttaacgggttacccggggacgtcgttaagtaaccgggg

SEQ ID NO: 378844 - DNA, 748 bp, Homo sapiens
  misc_feature: GZ8MTXP01C35LN.44.70.G04.1.454.CMB.2.raw
  modified_base (290)..(290): a, c, t, g, unknown or other
  modified_base (362)..(362): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgctctttttaagaggtgtccactgtcaggtgcacctggtggagtcgtgggggaggcgtggtccagccgtggggaggtccctgagactctcctgtgaagcctctggattttagttcagttggtcnggcatcgcacgtcgggtcccgccaggcctccgaggccggaagggggccggagttggttggcagttatagcanagtgaattgggaatttctaggtaaaaaacttagtttaagcgacgtaaaggaccttcccggggtaagggaaacggggcccctatttaccaacctaagttacccgtaccaaaggtaaacggtaaaccctaacgtttaccccgggaaatagttttcggtaacgggttaacctttaggggggaaaacttcggggtaacctagggcccttaaggaagggttacgtaccggggaaacggtccgttacgggtccctttgggtaagtttaacgtttaccgtgggttacggtacggtaagggttaaccggtttgggggaagggtttaagggttaaaaggtttaacggttttacccgggacccggggttacgtaaccgttaagggttaacccgggg

SEQ ID NO: 378845 - DNA, 677 bp, Homo sapiens
  misc_feature: GZ8MTXP01A9F8L.44.70.G04.1.454.CMB.2.raw
  modified_base (202)..(202): a, c, t, g, unknown or other
  modified_base (256)..(256): a, c, t, g, unknown or other
  modified_base (288)..(288): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacaatctccagccaccctgtctttgtctccgaggggaaancgccaccctctcctgcagggccagtcagagtgtagaactatagctggtatcaanagacacctggccaggcctacccaggcctcctnatctatgatgcatccgaagtcgggggccgcgggcactccccaaggtccgtaagggtttccaaggttcggactagggttccggggtctaggacgaacagtaaccttcaactctccaaccgtatccgaagggccggtactacgggacggtaccggaaaggttagtttcgacttaaggttttaacttacgtcgttaaccaaaccgtaccggttaagacccggtacggtacggggttacccgttaacgggttacggtaggttttccgggaccggttaaacgggggaaccaaacggtccggttagggacgtacctaaacggaaaacgttacgtggttcgacgtgaccgccttacgtcttacgttcctacctattccccgttaacccgcttaacg

SEQ ID NO: 378846 - DNA, 620 bp, Homo sapiens
  misc_feature: GZ8MTXP01A9YBZ.44.70.G04.1.454.CMB.2.raw
  modified_base (263)..(263): a, c, t, g, unknown or other
  modified_base (306)..(306): a, c, t, g, unknown or other
  modified_base (357)..(357): a, c, t, g, unknown or other
  modified_base (504)..(504): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccatgtcaggtgcacgtggtggagtcgtgggggagcgtggtccagccgtgggacgtcctgagtctctctgtgaagcctntggtatttagttcaggtgtctggctagtgctacgtcgggtccncacggctccgaggaccgtaacgggggccggtagttggtacggctaggttanagcacatgataggtaattcgagtaaaatattgtcgactaacgtacgtccgggtacggaacgggtcccgattcccaactatctaccgaagtacgaactacgttacccggaattagttcgtattacgtaggggaaactggtacagtccnggagacgtacgaggtcctcggtctcttaaggtacttacggtcgaggtacggaggttacggttcggggagggttaagtaggttaaggttacggtccgggcgtaagttcggtaacggg

SEQ ID NO: 378847 - DNA, 620 bp, Homo sapiens
  misc_feature: GZ8MTXP01A3OAI.44.70.G04.1.454.CMB.2.raw
  modified_base (282)..(282): a, c, t, g, unknown or other
  modified_base (301)..(301): a, c, t, g, unknown or other
  modified_base (337)..(337): a, c, t, g, unknown or other
  modified_base (342)..(342): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctctggatttagttcagtggtcnggcatgctacgtgggtccncaggctccgaggcaagggggcgagtggtgctagtanagcantgatggaagttcagtaaaatattaagtggcctaaggtacctccggtaggaaacggggtcctattcaaccctaatcgtaccaagaacgacctaaacgttccccggaaatagttgtacgttacttagggggaaacttggggtacacgtccgtaggacggtagtaccggaggtacctcgggtccttcgtgttaattacgtggttgacggtaggaacggttcgggggagggttaagggtaagttgggttaacgttcccgggggacgtccgttaagtccgggg

SEQ ID NO: 378848 - DNA, 592 bp, Homo sapiens
  misc_feature: GZ8MTXP01DIUHW.44.70.G04.1.454.CMB.2.raw
  modified_base (263)..(263): a, c, t, g, unknown or other
  modified_base (267)..(267): a, c, t, g, unknown or other
  modified_base (275)..(275): a, c, t, g, unknown or other
  modified_base (282)..(282): a, c, t, g, unknown or other
  modified_base (289)..(289): a, c, t, g, unknown or other
  modified_base (296)..(296): a, c, t, g, unknown or other
  modified_base (331)..(331): a, c, t, g, unknown or other
  modified_base (514)..(514): a, c, t, g, unknown or other
  modified_base (541)..(541): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgtttgttcttttaagaggtgtccactgtcaggtgcaccgtggtggagtcgtgggggagcgtggtccagccgtgggacgtcctgagctctctgtgagtctntgtntttagttnagtgtcngcatgcngtggccncagctcgagcgagggcgagtggtgctagtatgcangtgatggtaattctataatattatgactagtacctacggagaacggggtctaatccacgacttacaccgagaacgaactaacgttacccgaatagttgtacgttaagtcggaaacgttggtactagtccgttaggaacggtgtaccgggtaaggaccttgggtaccttgttaagtctttacgnggttcggacgtaggaggttacgggggngtttacgggaagtttaagttcggtacgggcttagtaagttcggaaccgggg

SEQ ID NO: 378849 - DNA, 662 bp, Homo sapiens
  misc_feature: GZ8MTXP01BOG7F.44.70.G04.1.454.CMB.2.raw
  modified_base (255)..(255): a, c, t, g, unknown or other
  modified_base (303)..(303): a, c, t, g, unknown or other
  modified_base (358)..(358): a, c, t, g, unknown or other
  modified_base (408)..(408): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtnaagccctgtggatttagttcagtggtactggcatgcacgtggggtccncaggctcccgagggcctaaaggggggcccgtaggtcggttgggactaaggtttanaggccacgagttccgaattgggaaagttctggaaaaaattatttaacggngacaacggtaccgtcggtagggaaacgggtcctacttaccacctatcctaccgaagtaaacgacctaacgttaccccggaatagttacgtacgttaacgtaaggggtaaacttggaacctacgtccgtaaggacggtaacggtaccgaacggtacctacggtccttcgttaagttaacttacgtgttagacgaggttacggttcgggttaaggttggtaagttaaccgttaacggtccgggctaacgaagtcgg

SEQ ID NO: 378850 - DNA, 526 bp, Homo sapiens
  misc_feature: GZ8MTXP02H5YLQ.44.70.G04.1.454.CMB.2.raw
  modified_base (195)..(195): a, c, t, g, unknown or other
  modified_base (310)..(310): a, c, t, g, unknown or other
  modified_base (376)..(376): a, c, t, g, unknown or other
tcagacagtatatacacgaccggtgctcgatttagtgtagtgtgaagggaagggaggaactgctcagttaggacccagagggaaccatggaagcccagctcagcttctcttcctcctgctactctggctccagataccacggggaaattgtgttgacacaatctccagccacctgtctttgtctccaggggaaanagccacctctcctgcagggccagtcagagtgttagaactacttagcctggtatcaacagacacctggccaggctccaggctcctcatctatgatgcatccaaagtacggggccgngggcactccccagccaggttcaggtggcagtcgggctgagacagtacttcactctcaccatcagcnctagagcggaagtatttgctagtttattacttgtactacaccgtagcgactggtactaggtacgtagtttggacgacgggacgagacgtaggagactacgaaaacgactagtacggctacgcacatcgtctcttctacttcctccgtcac

SEQ ID NO: 378851 - DNA, 549 bp, Homo sapiens
  misc_feature: GZ8MTXP02F7KPO.44.70.G04.1.454.CMB.2.raw
  modified_base (339)..(339): a, c, t, g, unknown or other
  modified_base (344)..(344): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagtttcagtggttctggcatgcacgtgggtccgcaggctccgaggcaaggggccgagtggtgcagttanagcanatgatggaattctagaattattatgacagacctccgtaggaaacgggcctattcaccagttcctccaagacgacaaacgttccccggaatagttgtagtacttaggaaatggtcagcctagagtagtcgaggactcggctcgtgtattacgtggtgcgagacgtcggggagtggtagtagttacgttaccggggctacgagtcgg

SEQ ID NO: 378852 - DNA, 521 bp, Homo sapiens
  misc_feature: GZ8MTXP02IP02D.44.70.G04.1.454.CMB.2.raw
  modified_base (366)..(366): a, c, t, g, unknown or other
  modified_base (440)..(440): a, c, t, g, unknown or other
tcagacagtatatacacgaccggtgctcgatttagtgtagtgtgaagggaaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagcccccggaaaggccctggagtggatcgcactcacttatggaatgacgatatacgatatagtccttctctgacgaccagactcacgcctcacgaaggacacgtacccaaaaaccnggtcgtaccttacattcgaccaacgtcggaccctgtggacacaggcacatatttctgtgcccattcatgaccanatgaccacggcttcttcgacctgggcagggactcaggtcacgtctcactcagcctccacacggcccagtcggtcttccccg

SEQ ID NO: 378853 - DNA, 523 bp, Homo sapiens
  misc_feature: GZ8MTXP02JZ41T.44.70.G04.1.454.CMB.2.raw
  modified_base (365)..(365): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttaggaactacttagcctggtatcaacagacacctggccaggctcccaggctcctcatctatgatgcatccaatcggggccgcgggcatccccagccaggttcagtggcaggtgggtctgagacagacttcnctctcaccatcagcgctagagcggagtatttgctagtttattactgtcacaccgtagcgactggctaggtactagtttggccgtagggaccgagcgtggagctacgaaacgacgtcggtgctcgacaccatcgtcgtcttctacttccttcccgctac

SEQ ID NO: 378854 - DNA, 554 bp, Homo sapiens
  misc_feature: GZ8MTXP02ILRE1.44.70.G04.1.454.CMB.2.raw
  modified_base (196)..(196): a, c, t, g, unknown or other
  modified_base (254)..(254): a, c, t, g, unknown or other
  modified_base (487)..(487): a, c, t, g, unknown or other
tcagacagtatatacacgaccggtgctcgatttagtgtagtgtgaagggaaaggggaggaactgctcagttaggacccagagggaaccatggaagcccagctcagcttctcttcctcctgctactctggctccagataccaccgggaattgtgttgacacaatctccagccacctgtctttgtctccaggggaaanagccacctctcctgcagggccagtcagagtgttagaactacttagcctggtatcaacngacacctggccaggcctcccaggcctcctcatctatgatgcatccaaagtacggggcccgcggcactccccagccctaggttcagtggctaggtcggggtctggacgacagacctttcacttctcaccatccaggcgccagacgcggaagtatttgcttagtttattaattacgtacaacacgtagacgtacgtcggtccgtaggtacgtagtttcggcgtaggggactaggngtggagtctacgaaaacgacgtacgtggctcgcacctatcgtcgtccttactactccttccctctac

SEQ ID NO: 378855 - DNA, 519 bp, Homo sapiens
  misc_feature: GZ8MTXP02JHV27.44.70.G04.1.454.CMB.2.raw
  modified_base (200)..(200): a, c, t, g, unknown or other
  modified_base (312)..(312): a, c, t, g, unknown or other
  modified_base (346)..(346): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctccagataccaccggggaaattgtgttgacacaatctccagccaccctgtctttgtctccaggggaaangccaccctctcctgcagggccagtcagagtgttagaactattagcctggtatcaacagacacctggccaggctcccaggctcctcatctatgatgcatccaaataggggccncgggcatcccagccaggttcagtggcagtggtcngagacagacttcactctcaccatcagcgcctagagcggaagatttgctagtttatactgtcaaacacgtagcgactggcctaggtactagtttcggacgaggggaccaagcgtaggagctacgaaaacgaatcgtggactgacaccatctctcttacactccttcccgcttac

SEQ ID NO: 378856 - DNA, 523 bp, Homo sapiens
  misc_feature: GZ8MTXP02HYK4Y.44.70.G04.1.454.CMB.2.raw
  modified_base (365)..(365): a, c, t, g, unknown or other
  modified_base (379)..(379): a, c, t, g, unknown or other
  modified_base (417)..(417): a, c, t, g, unknown or other
tcagacagtatatacacgaccggtgctcgatttagtgtagtgtgaagggaaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggccccccggaaaggccctggacgtggatcgcactcacttatggaatgacgatatacgatatagtccttctctgacgaccagactcacgcctcacgagacacgtaccaaaacnggtgtcttacattnaccaaacgtggaccctgtggacacaggcacattattcngtgcccattcatcgaccacaatgaccacgggcttctcgaaccctgggacccagggaactccaggtcacgtctcgatccagcctcaccaggcccagcgtcctccccg

SEQ ID NO: 378857 - DNA, 707 bp, Homo sapiens
  misc_feature: GZ8MTXP02JLC1Q.44.70.G04.1.454.CMB.2.raw
  modified_base (329)..(329): a, c, t, g, unknown or other
  modified_base (392)..(392): a, c, t, g, unknown or other
  modified_base (617)..(617): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggggacgtccgtgacgactcctccgtggtagaacgtcctgtaggttattttacgttctaggttggttcgtggctagtcgctacggtcggggtccccncggacggtccgtaccgaggacggaacgggggccggtagggttgggttcggacgtaaggtttanacgaccaacgtagtaggtagtagggtaacgtttcgtaagtaaatttatttagcgacgaacgtaccgtccgggtagggaaccgggtcctaacttcccaaactcgtccaccgaagactaactaaccgttacccgaaattgttggtacgttagtaaggaagttcggacacgtctaggaacgtacggttacggaacggtcgtcggtcttcgttagttaacgtttccggnggtacggacgtaacgggtacgggtaggggtagggttaaggttaacggtttaacggtttaccggggaccggcgttacggtacggtacgggg

SEQ ID NO: 378858 - DNA, 551 bp, Homo sapiens
  misc_feature: GZ8MTXP02J2IOU.44.70.G04.1.454.CMB.2.raw
  modified_base (199)..(199): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctcccagataccaccgggaattgtgttgacacaatctccagccaccctgtctttgtctccaggggaaanagccaccctctcctgcagggccagtcagagtgttaggaactacttagcctggtatcaacagacacctggccaggctcccaggcctcctcatctatgatgcatccaagtcggggccgcgggcacgtccccagccgtaggttcagtggcaggtcggggtctggacgacagaccttcactctaccaccatcaggccgcctagacgaccggagtatttgctagtttatactgtacactacgtagcgacgtgctagtacgtagtttcgacgtacgggacgagcgtagacgactacgaaacgacgtaggtcgacgtacgaccacctactcgtcgtcttactactccttccccgactac

SEQ ID NO: 378859 - DNA, 595 bp, Homo sapiens
  misc_feature: GZ8MTXP02I8STI.44.70.G04.1.454.CMB.2.raw
  modified_base (301)..(301): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagttcagtgttctggcatgcacgtgggtccnccagctccgaggccgaaggggccggaggtggttgggctagttatagccacatggatgggaaagtttctagaaattattatgacagaccttccgggtagaaacgggggccctaattccaaccctattccgtacccaagtaacgacctaaacgttacccccggaatagtttcgtaggttaactttaggggaaaacttgggtaccagccctagacgaggtcgaggactcggcttctagtacttactgagcgagacgtcggggagttggtagtagttacgtaccgggctctagtacgg

SEQ ID NO: 378860 - DNA, 587 bp, Homo sapiens
  misc_feature: GZ8MTXP02HVRHD.44.70.G04.1.454.CMB.2.raw
  modified_base (520)..(520): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtgggaggtccctgagactctcctgtgaagcctctggatttagttcagtggttctgggcatgcacgtggggtcccgcaggcctccaggcgaaggggccggagtggttggctagttatagcacatgatggaagttcagtaattattatgacagacgtccgtgaaacggccgattccactatctaccagacgactaacttcccggaaactattgtagtacgttaggtaaatcgggtacaggtcctggtaacgagtacggagggacctcgggcttcgttgtaacttttacgngtcgacgtaggtacggtcggggtaggttggtaaggttacgttacggtaccgggacgtacgtagtcgg

SEQ ID NO: 378861 - DNA, 527 bp, Homo sapiens
  misc_feature: GZ8MTXP02G6APF.44.70.G04.1.454.CMB.2.raw
  modified_base (200)..(200): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctccagataccaccggggaaattgtgttgacacaatctccagccaccctgtctttgtctccaggggaaanagccacctctcctgcagggccagtcagagtgttaaggaactacttagcctggtatcaacagacactggccaggcctcccaggcctcctcatctatgatgcatccaaagtaggggccgcgggcactcccagccaggttcaggtggcaggtcgggtctgagacagacttcactcacaccatcagccgactagagaccggaagtatttgactagtttattactgtacaacacgtagcgactcggctaggtactagtttacggcgagggacaagcgtaggagactacaaaacgactgtcggctcgcacatctgtctcactcctccgtctac

SEQ ID NO: 378862 - DNA, 519 bp, Homo sapiens
  misc_feature: GZ8MTXP02G9AS0.44.70.G04.1.454.CMB.2.raw
  modified_base (200)..(200): a, c, t, g, unknown or other
  modified_base (256)..(256): a, c, t, g, unknown or other
  modified_base (288)..(288): a, c, t, g, unknown or other
  modified_base (311)..(311): a, c, t, g, unknown or other
  modified_base (349)..(349): a, c, t, g, unknown or other
  modified_base (352)..(352): a, c, t, g, unknown or other
  modified_base (358)..(358): a, c, t, g, unknown or other
  modified_base (362)..(362): a, c, t, g, unknown or other
  modified_base (385)..(385): a, c, t, g, unknown or other
tcagacagtatatacacgaccggtgctcgatttagtgtagtgtgaagggaaagggaggaactgctcagttaggacccagagggaaccatggaagccccagctcagcttctcttcctcctgctactctggctcccagataccaccggggaaattgtgttgacacaatctccagccaccctgtctttgtctccaggggaaanagccacctctcctgcagggccagtcagagtgttagactattagcctggtatcaacngacactggccaggctcccaggctctcatctangatgcatccaaagtacggggccncgggcatccccagccaggttcagtggcagtgggctganacngacttnctcncaccatcagcgctagagcggaantttgctagtttatactgtacaacacgtagcgactggcctaggtactagtttcggaccgtaggggaccaaggcgtaggacgctacgaaaacgactacgtggctcgacaccatctgtctcactccttcccgactac

SEQ ID NO: 378863 - DNA, 728 bp, Homo sapiens
  misc_feature: GZ8MTXP02IDU1U.44.70.G04.1.454.CMB.2.raw
  modified_base (196)..(196): a, c, t, g, unknown or other
  modified_base (263)..(263): a, c, t, g, unknown or other
  modified_base (285)..(285): a, c, t, g, unknown or other
  modified_base (303)..(303): a, c, t, g, unknown or other
  modified_base (343)..(343): a, c, t, g, unknown or other
  modified_base (348)..(348): a, c, t, g, unknown or other
  modified_base (370)..(370): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgcttcttttaagaggtgtccactgtcaggtncacctggtggagtcgtgggggagcgtggtccagccgtgggagtccctgagctctcctgtgaagcctntggtatttagttcagtggttcnggcatgcacgtgggtccncgaggctccgaggcgaaggggccgagtggttgctagttanagcanatgagtgagttcagaattatgngacacgactccggtaggaaacgggtccgacttcaccctatcctaccgaagacgaacctaacgtttaccccggaaacttagtttacgtacggtttaaaccgtttaagggtaaaatttcggggtacctaacgggtacccttaggggaaacgggtaacggttaccggggaaacggggttaacccgttccgggggtaccctttacggtttacggtttaaacgttttaccggtaggttacgggaccgggttaaaagggtaccggggtttaacgggggtaaagggggtttaacggggtttaaacggtttaagggttttaaaccgggttacccgggggacttaccggtaaaggtttacccggggg

SEQ ID NO: 378864 - DNA, 660 bp, Homo sapiens
  misc_feature: GZ8MTXP02JIU67.44.70.G04.1.454.CMB.2.raw
  modified_base (301)..(301): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggagtccctgagactctcctgtgaagcctctggtatttagttcagtggttctgggcatgcacgtgggccnccaggctccgaggcaaggggccgagtggttggcaggttatagcacatcgatgggaatttcaggaaattacttagtggactaaggaccttcccgggtaggaaaacggggtccctaaatttccaaccctatcctacccaaagagtaaccaaagtttcccccggaaatacgtttgtaggtaaccttaggggtaaaattcggggttaccaaggcccgttaggaaaggtacggttaccggaagggaccttcggggtaccctcgtttacggtaaatttaccgtggtggtaccggagtaccgggttacgggggagttggggttaagttaggttttacgtacccgggggcctacgtaacgttcgggg

SEQ ID NO: 378865 - DNA, 529 bp, Homo sapiens
  misc_feature: GZ8MTXP02ICLKD.44.70.G04.1.454.CMB.2.raw
  modified_base (302)..(302): a, c, t, g, unknown or other
  modified_base (339)..(339): a, c, t, g, unknown or other
  modified_base (364)..(364): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctctggatttagttcagtggttctggcatgcacgtgggtcccncaggctccgaggcaaggggccgagtggtgctagttanagcacatgatggattcagaattatntgactagacctccgtagacgggccattcacatctacagagacaattcccggaatattgtatacgttaggaaattggtacagcctaggagagtacggagactcggctcgtgtattacgtgtgcgagacgtcgggagtggtagtagttacgtaccggctcgagtcgg

SEQ ID NO: 378866 - DNA, 573 bp, Homo sapiens
  misc_feature: GZ8MTXP02GPJXA.44.70.G04.1.454.CMB.2.raw
  modified_base (371)..(371): a, c, t, g, unknown or other
  modified_base (381)..(381): a, c, t, g, unknown or other
  modified_base (529)..(529): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactccgtggagagggtcgttgtcgtgggtgcggcaccggacccccggaaggcccgtggagtggatcgcactcacttagtggaatgacgatatacgatatagtccttctctgacgacagactcacgcctacacgaagacactaaccaaaacnggtcgtctanatcgacacgtcgacctgtacggacacgaggcacattattctgtcgccctacttcatcgaccaacaatcgaccgtacgggtccttacgttaccgaacccgtcggggaccaacgggtaactccgaacggtccaccgtctacgactcgacncccgtaccgaaccgacggccctacgtcccggtcccttcccccgg

SEQ ID NO: 378867 - DNA, 606 bp, Homo sapiens
  misc_feature: GZ8MTXP02F73Q1.44.70.G04.1.454.CMB.2.raw
  modified_base (303)..(303): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagcctgggaggtccctgagactctcctgtgaagcctctggatttagttcagtggttctggcatgcacgtgggtccnccgaggctccgaggcaaggggccggagtggttggctaggttatagcacatgatggaagttctagaaattattatgactaaacgtccgtcggaaggaccgggtctactaccactctaccacgaagacaacgttaccgtaaccgaattacgttgtacgttagtaaagtaggttcgacgacgtcgagagtacggtacggacgtccgtcgtactgttagttacttcggttgacgacggtacgtacgggtcggggttaggttaaggttaggttaacggttaccgggtaccggcgtacgtaggtacggg

SEQ ID NO: 378868 - DNA, 528 bp, Homo sapiens
  misc_feature: GZ8MTXP02G5VBR.44.70.G04.1.454.CMB.2.raw
  modified_base (283)..(283): a, c, t, g, unknown or other
  modified_base (300)..(300): a, c, t, g, unknown or other
  modified_base (335)..(335): a, c, t, g, unknown or other
  modified_base (340)..(340): a, c, t, g, unknown or other
  modified_base (360)..(360): a, c, t, g, unknown or other
  modified_base (373)..(373): a, c, t, g, unknown or other
  modified_base (476)..(476): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctctggatttagttcagtggttcnggcatgcactgggtccncaggctccaggcaaggggccgagtggtgcagttanagcanatgatggaagttcagaattntatgcagctccgngaacggccattcacatctccagagacaacttacccggaatacgttgtagtacgttaggaaatggtacagcctgagagtcgaggtactcggctgtgtattacgngtgacgagacgtcgggaggtgtagtagttacgtaccgggctacgagtacggg

SEQ ID NO: 378869 - DNA, 539 bp, Homo sapiens
  misc_feature: GZ8MTXP02HM2KB.44.70.G04.1.454.CMB.2.raw
  modified_base (306)..(306): a, c, t, g, unknown or other
  modified_base (348)..(348): a, c, t, g, unknown or other
  modified_base (353)..(353): a, c, t, g, unknown or other
  modified_base (402)..(402): a, c, t, g, unknown or other
  modified_base (422)..(422): a, c, t, g, unknown or other
  modified_base (527)..(527): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtgggaggtccctgagactctcctgtaaacgcctctggtatttagttcagtgttctggcatgcacgtgggtcccncgaggcctccgaggcgaaggggccggagtgggttgcagttanagcanatgatgaattcagaatattatgctagactcgtgaagggccatcacatcncagagacaacgttcccgaanagttgtgtacttggaaatggtacagcctagagagtcggagacgtcggcttctagtattactgagcgagacgtcgggtaggtggtaagttagtacgttacccgggngtcgagtacgcg

SEQ ID NO: 378870 - DNA, 619 bp, Homo sapiens
  misc_feature: GZ8MTXP02J17PX.44.70.G04.1.454.CMB.2.raw
  modified_base (258)..(258): a, c, t, g, unknown or other
  modified_base (262)..(262): a, c, t, g, unknown or other
  modified_base (302)..(302): a, c, t, g, unknown or other
  modified_base (341)..(341): a, c, t, g, unknown or other
  modified_base (345)..(345): a, c, t, g, unknown or other
  modified_base (356)..(356): a, c, t, g, unknown or other
  modified_base (362)..(362): a, c, t, g, unknown or other
  modified_base (367)..(367): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtgggagtccctgagactctctgtgancctntggtatttagttcagttggtctggcatgcacgtgggtccncgaggctccgaggcgaaggggccgagtggtgctagttangcanatgatggattngaattnttagngacagactcgtagaacggcctatccactatcaccgagacactaacgttacccgaatagttcgagttaacgtaggaaacgttggtacacggtcctaggaacggttaggtaccggaacgggtacctccgggtacttcgttagtttaacttaccggtaggtacggacggaacgtacgggttacgggggttaagggttaagggttaaaccggtttacgggtttaaccggttacccgggccgtaacgtacggtcggg

SEQ ID NO: 378871 - DNA, 590 bp, Homo sapiens
  misc_feature: GZ8MTXP02JA8ZD.44.70.G04.1.454.CMB.2.raw
  modified_base (347)..(347): a, c, t, g, unknown or other
  modified_base (366)..(366): a, c, t, g, unknown or other
  modified_base (368)..(368): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggacgtccctgagactctcctgtaaagcctctggatttagttcagtggttctggcatgcacgtgggtcccgcaggctcgaggcgaaggggccgagtggtgctagttatagcacntgatggagtcagaatattngnagactcgtagaacggctatcacctatccacagacgacacgttacccggaaatgttcgtagttacgttaggaaatcgggttacacggtaccgtaggaacgtacggtacggaacgggtacgtcgggtcttccgtagttacgttacgtggtacggtacgaggtacgtcgggggtaggttaggtaaggttacgttacggttaccggggctacgtagttcggacggg

SEQ ID NO: 378872 - DNA, 705 bp, Homo sapiens
  misc_feature: GZ8MTXP02F7BSU.44.70.G04.1.454.CMB.2.raw
  modified_base (305)..(305): a, c, t, g, unknown or other
  modified_base (344)..(344): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtgggaggtccctgagactctcctgtgaagcctctggtatttagttcagtggttctggcatgcacgtgggtccnccaggctccgaggcgaaggggccgagtggtggcagttanagcacatcgatggaagtttctagtaaattattacgtgactaaggtacccttccgggtaggaaacgggggccctaagtttcccaaacccgtattcccgtaccgaaaggtaaccgaaccttaaacggtttcccccgggaaaattacgtttacggttacggtttaaaccgtttaggggaaaacgtttcggggtaaccctacgggtacccttagggaaggtacggttcccgggaaaggtacccgttcggggtcttaccgtttaggttaaccgtttagtcggtacggaccggtaggtaacggtcgggggtaaggttcgggttaaggttacggtttacggttaccggggcgtacgtaggttacgggg

SEQ ID NO: 378873 - DNA, 532 bp, Homo sapiens
  misc_feature: GZ8MTXP02FYYOR.44.70.G04.1.454.CMB.2.raw
  modified_base (367)..(367): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgccactcctggagagggcgttgtctgggtgcggcacgcccccggaaaggccctggagtggatcgcactcacttattggaatgacgatatacgatatagtccttctctgacgaccagactcacgcctcacgaagacacgtaccaaaaaccnggtacgtccttacattgaccaacgtgaccctgtgacacaggcacatattctgtcgcccacttccattcgaccacaatgaccgaggcttctacgaaccctggggccaggactccgaggtccaccgtctcactcacgcctccacacggcccagtccgtcttcccccg

SEQ ID NO: 378874 - DNA, 759 bp, Homo sapiens
  misc_feature: GZ8MTXP02G1EAV.44.70.G04.1.454.CMB.2.raw
  modified_base (201)..(201): a, c, t, g, unknown or other
tcagacagtatatacacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacaatctccagccaccctgtctttgtctccaggggaaangccaccctctcctgcagggccagtcagagtgttaggaactacttagcctggtatcaacagacacctggccaggcctcccaggctcctcatctatgatgcatccaagtcggggcccgcgggcactccccagccaggttcaggtcggcgtaggtcggggtctaggaacgacagtaccttcgacttcctacaaccatccgaacggccggtaccctaaggacggtacccgggtaaagtacgtttttacggacgtttaaaggttttaactttaaccgttacggtaacctaaaaccgtacccggttaaaggacccggttaaaccggttcggggttaacccgttaacggggttaaccggtttaacgggtttttaccggggaacccggtaaaccggggggtaaacccgtaaaacggggtcccggttaaggggaaccggtaacccgttaaaaccggtaaaaaccggtaaaccgttcgggtacgggtaccgttacggtacccaaccgtaacgttccgttcgttaccctttacctaccgtttcccctttaccccggtaccgtttaaccg

SEQ ID NO: 378875 - DNA, 694 bp, Homo sapiens
  misc_feature: GZ8MTXP02GHX0N.44.70.G04.1.454.CMB.2.raw
  modified_base (310)..(310): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgctcttttaagaggtgtccactgtcaggtgcacctggtggagtcgtgggggaggcgtggtccagccgtgggaggtccctgagactctcctgtgaagcctctggtatttagttcagttggttctggcatgcacgtcggggtcccnccgaggcctccgagggccgaaggggcccggtaggtcgggttggctaggttatacgcaactagtgataggggtaattctagaaattattagtgactaagtacccgttccgggtaggaaacggggtccccgtaattcccaacccgtattcccgtaccgaaggacgaacctaaacgttaccccgggaaattacgttggtacgttacgttaggggaaaacttgggtaccaaggtccctaggaacggtacgtacgggaacgggtaccctcggggtccttcgtttagttaacgtttaccgtgggttacgacggtaagtacggttagggggtaggttaagggttaaggtttaacggtttaacgggtcccggggactcggtaagttccgggg

SEQ ID NO: 378876 - DNA, 551 bp, Homo sapiens
  misc_feature: GZ8MTXP02G3KF7.44.70.G04.1.454.CMB.2.raw
  modified_base (265)..(265): a, c, t, g, unknown or other
  modified_base (278)..(278): a, c, t, g, unknown or other
  modified_base (286)..(286): a, c, t, g, unknown or other
  modified_base (305)..(305): a, c, t, g, unknown or other
  modified_base (343)..(343): a, c, t, g, unknown or other
  modified_base (369)..(369): a, c, t, g, unknown or other
  modified_base (371)..(371): a, c, t, g, unknown or other
  modified_base (544)..(544): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagcctggggacggtccctgagactctcctgtgagcctntggatttagttcngtggttcnggcatgcacgtggggtccncaggctccgaggcaaggggccgagtggttggcagttanagcacatcgatggaagttctgaattntngacacgactccgagaagggccattcactatctacagagacaacttacccggaactagttgtagtaacgttggaaatgggtacacggtcctagagagttcggaggtacctcgggactcgtaggttacttacgtgtgcgtagacgtcggggagtggtagtacggttactccgggncagtcgg

SEQ ID NO: 378877 - DNA, 546 bp, Homo sapiens
  misc_feature: GZ8MTXP02JXQI8.44.70.G04.1.454.CMB.2.raw
  modified_base (369)..(369): a, c, t, g, unknown or other
  modified_base (444)..(444): a, c, t, g, unknown or other
tcagacagtatatacacgaccggtgctcgatttagtgtagtgtgaagggaaagggggactcctgtgccccaccatagacacactttgctccacgctcctgctgctgaccatcccttcatggggcctgtcccagatcaccgtgaaagagtctggccctacattggtgaaacccacacagaccctcacgctgacctgcaccgtctcaggccttctcactcgtcactcctggagagggcgttgtcgtgggtgcggcacggccccccggaaaggccctggagtggatcgcactcacttatggaatgacgatatacgatatagtccttctctgaccgacagacctcacgcctcactaagacacgtaccaaacgngtcgtacttacattcgaccaacgtcgaccctgtcgacacgagcacattacttctgtcgccctattcatcgaccanacagacccacgggtcttcgtccgaccgtcggggaccaggactccgaggtccaccgtctcactcacgcctcccaccgtacggcccacgtcccggtctcccccg
